(12) United States Patent
Sun et al.

(10) Patent No.: US 12,281,166 B2
(45) Date of Patent: *Apr. 22, 2025

(54) METHODS OF TREATING INFLAMMATORY DISEASES BY BLOCKING GALECTIN-3

(71) Applicant: TrueBinding, Inc., Foster City, CA (US)

(72) Inventors: Dongxu Sun, Los Altos, CA (US); Catherine A. Gordon, Fremont, CA (US); Ksenya Shchors, San Mateo, CA (US); Yan Wang, Concord, CA (US); Tsung-Huang Tsai, San Carlos, CA (US); Yew Ann Leong, San Francisco, CA (US)

(73) Assignee: TrueBinding, Inc., Foster City, CA (US)

( * ) Notice: Subject to any disclaimer, the term of this patent is extended or adjusted under 35 U.S.C. 154(b) by 0 days.

This patent is subject to a terminal disclaimer.

(21) Appl. No.: 17/303,268

(22) Filed: May 25, 2021

(65) Prior Publication Data

US 2021/0371533 A1 Dec. 2, 2021

Related U.S. Application Data

(60) Provisional application No. 63/030,069, filed on May 26, 2020.

(51) Int. Cl.
| | | |
|---|---|---|
| *C07K 16/28* | (2006.01) | |
| *A61K 39/00* | (2006.01) | |
| *A61K 39/395* | (2006.01) | |
| *A61P 19/04* | (2006.01) | |
| *A61P 31/14* | (2006.01) | |
| *A61P 37/06* | (2006.01) | |

(52) U.S. Cl.
CPC ........ *C07K 16/2851* (2013.01); *A61K 39/395* (2013.01); *A61P 19/04* (2018.01); *A61P 31/14* (2018.01); *A61P 37/06* (2018.01); *A61K 2039/505* (2013.01); *C07K 2317/56* (2013.01); *C07K 2317/565* (2013.01)

(58) Field of Classification Search
None
See application file for complete search history.

(56) References Cited

U.S. PATENT DOCUMENTS

| | | | |
|---|---|---|---|
| 4,179,337 A | 12/1979 | Davis et al. | |
| 4,301,144 A | 11/1981 | Washita et al. | |
| 4,495,285 A | 1/1985 | Shimizu et al. | |
| 4,496,689 A | 1/1985 | Mitra | |
| 4,609,546 A | 9/1986 | Hiratani | |
| 4,640,835 A | 2/1987 | Shimizu et al. | |
| 4,670,417 A | 6/1987 | Iwasaki et al. | |
| 4,766,106 A | 8/1988 | Katre et al. | |
| 4,791,192 A | 12/1988 | Nakagawa et al. | |
| 5,208,020 A | 5/1993 | Chari et al. | |
| 5,229,275 A | 7/1993 | Goroff | |
| 5,270,202 A | 12/1993 | Raychaudhuri | |
| 5,405,783 A | 4/1995 | Pirrung et al. | |
| 5,412,087 A | 5/1995 | McGall et al. | |
| 5,416,064 A | 5/1995 | Chari et al. | |
| 5,445,934 A | 8/1995 | Fodor et al. | |
| 5,567,610 A | 10/1996 | Borrebaeck et al. | |
| 5,624,659 A | 4/1997 | Bigner et al. | |
| 5,695,937 A | 12/1997 | Kinzler et al. | |
| 5,928,885 A | 7/1999 | Nixon et al. | |
| 5,936,078 A | 8/1999 | Kuga et al. | |
| 5,948,626 A | 9/1999 | Hawkins et al. | |
| 5,968,797 A | 10/1999 | Ni et al. | |
| 5,969,108 A | 10/1999 | McCafferty et al. | |
| 5,985,660 A | 11/1999 | Galy | |
| 5,994,084 A | 11/1999 | Anderton et al. | |
| 6,087,153 A | 7/2000 | Greenwald et al. | |
| 6,150,584 A | 11/2000 | Kucherlapati et al. | |

(Continued)

FOREIGN PATENT DOCUMENTS

| | | |
|---|---|---|
| EP | 0 329 400 | 8/1989 |
| EP | 0 404 097 | 12/1990 |

(Continued)

OTHER PUBLICATIONS

US 10,308,710 B2, 06/2019, Grueninger et al. (withdrawn)
US 11,331,347 B2, 05/2022, Yao et al. (withdrawn)
US 11,339,200 B2, 05/2022, Yao et al. (withdrawn)
US 11,732,039 B2, 08/2023, Sun et al. (withdrawn)
Shi et al. 'Anti-galectin-3 antibodies induce skin vascular inflammation via promoting local production of IL-1β in systemic lupus erythematosus.' Int. Immunopharm. 112(2022) 109197.*
Abcam Anti-Galectin 3 antibody [A3A12] ab2785 product data sheet. printed Sep. 27, 2023.*
Ajjan et al., 2006, Coagulation and atherothrombotic disease, Atherosclerosis, 186:240-259.
Andrade et al., 2009, Rechallenge in drug-induced liver injury: the attractive hazard, Expert Opin. Drug Saf., 8(6):709-714.

(Continued)

Primary Examiner — Nora M Rooney
(74) Attorney, Agent, or Firm — KNOBBE, MARTENS, OLSON & BEAR LLP

(57) ABSTRACT

Disclosed herein are methods, antibodies, and compositions for disrupting an interaction between Galectin-3 (Gal3) and viral proteins, such as proteins of the SARS-CoV-2 virus or other coronaviruses, or viral-associated host proteins. Further disclosed herein are methods, medicaments, and compositions for the treatment of a disease or a disorder in a subject, such as the treatment of a viral infection, or treatment of a fibrosis, such as lung fibrosis, that develop as a sequela of a viral infection, or cytokine release syndrome. Further disclosed herein are methods, medicaments, and compositions for the treatment of an inflammatory disease or disorder, such as inflammation of the lungs or systemic lupus erythematosus, which may be associated with neutrophil activity, in a subject. Also disclosed herein are pharmaceutical antibody formulations for the treatment of a disease, such as a coronavirus infection.

9 Claims, 130 Drawing Sheets

Specification includes a Sequence Listing.

(56) References Cited

U.S. PATENT DOCUMENTS

| | | |
|---|---|---|
| 6,156,311 A | 12/2000 | Strickland et al. |
| 6,162,963 A | 12/2000 | Kucherlapati et al. |
| 6,174,708 B1 | 1/2001 | Sodoyer et al. |
| 6,187,287 B1 | 2/2001 | Leung et al. |
| 6,242,421 B1 | 6/2001 | Bowen et al. |
| 6,255,054 B1 | 7/2001 | Hugon et al. |
| 6,303,576 B1 | 10/2001 | Blaschuk et al. |
| 6,562,806 B1 | 5/2003 | Thurston et al. |
| 6,576,607 B1 | 6/2003 | Schachner |
| 6,608,192 B1 | 8/2003 | Thurston et al. |
| 6,677,116 B1 | 1/2004 | Blaschuk et al. |
| 6,716,821 B2 | 4/2004 | Zhao et al. |
| 6,727,075 B2 | 4/2004 | Fitzgerald et al. |
| 6,821,783 B1 | 11/2004 | Comely et al. |
| 6,825,164 B1 | 11/2004 | Stern et al. |
| 6,852,482 B1 | 2/2005 | Chrysler et al. |
| 6,884,869 B2 | 4/2005 | Senter et al. |
| 6,982,089 B2 | 1/2006 | Tobinick et al. |
| 7,014,855 B2 | 3/2006 | Schenk |
| 7,029,860 B2 | 4/2006 | Ota et al. |
| 7,049,311 B1 | 5/2006 | Thurston et al. |
| 7,067,511 B2 | 6/2006 | Thurston et al. |
| 7,115,260 B2 | 10/2006 | Dixit et al. |
| 7,214,715 B2 | 5/2007 | Beck et al. |
| 7,244,724 B2 | 7/2007 | Liu et al. |
| 7,270,818 B2 | 9/2007 | Averback |
| 7,276,497 B2 | 10/2007 | Chari et al. |
| 7,409,040 B2 | 8/2008 | Cyrulnik |
| 7,416,855 B2 | 8/2008 | He et al. |
| 7,485,712 B2 | 2/2009 | Mandelkow et al. |
| 7,498,298 B2 | 3/2009 | Doronina et al. |
| 7,528,126 B2 | 5/2009 | Howard et al. |
| 7,582,732 B2 | 9/2009 | Horie et al. |
| 7,611,910 B2 | 11/2009 | Balin et al. |
| 7,612,062 B2 | 11/2009 | Gregson et al. |
| 7,659,241 B2 | 2/2010 | Senter et al. |
| 7,662,816 B2 | 2/2010 | Cumming et al. |
| 7,700,823 B2 | 4/2010 | Casas et al. |
| 7,704,924 B2 | 4/2010 | Thurston et al. |
| 7,732,568 B2 | 6/2010 | Mattner |
| 7,750,116 B1 | 7/2010 | Doronina et al. |
| 7,846,679 B2 | 12/2010 | St. George-Hyslop et al. |
| 7,858,642 B2 | 12/2010 | John et al. |
| 7,910,590 B2 | 3/2011 | Huang et al. |
| 7,935,252 B2 | 5/2011 | Mattner et al. |
| 7,935,348 B2 | 5/2011 | Mattner et al. |
| 7,951,373 B2 | 5/2011 | Schachner |
| 7,955,812 B2 | 6/2011 | Moir et al. |
| 7,964,566 B2 | 6/2011 | Doronina et al. |
| 7,989,597 B2 | 8/2011 | Chang et al. |
| 8,008,449 B2 | 8/2011 | Korman et al. |
| 8,022,180 B2 | 9/2011 | Mattner et al. |
| 8,034,353 B2 | 10/2011 | Yano et al. |
| 8,060,179 B1 | 11/2011 | Flynn |
| 8,105,597 B2 | 1/2012 | Davies et al. |
| 8,105,839 B2 | 1/2012 | Urakami et al. |
| 8,163,736 B2 | 4/2012 | Gauzy et al. |
| 8,168,188 B1 | 5/2012 | Hoshi et al. |
| 8,173,775 B2 | 5/2012 | Iwatsubo et al. |
| 8,222,002 B2 | 7/2012 | Sugimura et al. |
| 8,232,373 B2 | 7/2012 | Wang |
| 8,257,740 B1 | 9/2012 | Sung et al. |
| 8,263,558 B2 | 9/2012 | Holzman et al. |
| 8,288,352 B2 | 10/2012 | Doronina et al. |
| 8,318,171 B2 | 11/2012 | Bush et al. |
| 8,318,687 B2 | 11/2012 | Tabira et al. |
| 8,323,925 B2 | 12/2012 | Chakravarthy |
| 8,338,379 B2 | 12/2012 | Yamaguchi et al. |
| 8,343,493 B2 | 1/2013 | VanMechelen et al. |
| 8,357,781 B2 | 1/2013 | Johnson-Wooed et al. |
| 8,394,380 B2 | 3/2013 | Manucharyan et al. |
| 8,404,678 B2 | 3/2013 | Bouchard et al. |
| 8,409,575 B2 | 4/2013 | Lannfelt et al. |
| 8,426,402 B2 | 4/2013 | Li et al. |
| 8,481,701 B2 | 7/2013 | Jarrige et al. |
| 8,487,099 B2 | 7/2013 | Greenlee et al. |
| 8,501,934 B2 | 8/2013 | Howard et al. |
| 8,518,975 B2 | 8/2013 | Aslanian et al. |
| 8,613,920 B2 | 12/2013 | Lieberburg et al. |
| 8,617,549 B2 | 12/2013 | Sierks et al. |
| 8,618,123 B2 | 12/2013 | Sasikumar et al. |
| 8,623,365 B2 | 1/2014 | Davies et al. |
| 8,633,185 B2 | 1/2014 | Howard et al. |
| 8,642,044 B2 | 2/2014 | Schenk et al. |
| 8,663,650 B2 | 3/2014 | Nicolau et al. |
| 8,664,411 B2 | 3/2014 | Wu et al. |
| 8,697,688 B2 | 4/2014 | Howard et al. |
| 8,703,714 B2 | 4/2014 | Doronina et al. |
| 8,710,193 B2 | 4/2014 | Irie et al. |
| 8,722,042 B2 | 5/2014 | Relkin |
| 8,748,386 B2 | 6/2014 | Sigurdsson |
| 8,778,885 B2 | 7/2014 | Cashman et al. |
| 8,784,810 B2 | 7/2014 | Lieberburg et al. |
| 8,796,319 B2 | 8/2014 | Combs et al. |
| 8,802,667 B2 | 8/2014 | Li et al. |
| 8,809,010 B2 | 8/2014 | Hoffmann et al. |
| 8,809,320 B2 | 8/2014 | Li et al. |
| 8,852,874 B2 | 10/2014 | Olas et al. |
| 8,871,720 B2 | 10/2014 | Doronina et al. |
| 8,877,192 B2 | 11/2014 | Mjalli et al. |
| 8,877,207 B2 | 11/2014 | Cimini et al. |
| 8,912,145 B2 | 12/2014 | Terakawa et al. |
| 8,933,295 B2 | 1/2015 | Jung et al. |
| 8,936,910 B2 | 1/2015 | Mitsch et al. |
| 8,993,833 B2 | 3/2015 | Colton et al. |
| 9,034,334 B2 | 5/2015 | Gellerfors et al. |
| 9,066,928 B1 | 6/2015 | Estus et al. |
| 9,089,614 B2 | 7/2015 | Lin et al. |
| 9,133,267 B2 | 9/2015 | Lee et al. |
| 9,163,062 B2 | 10/2015 | Sarasa Barrio |
| 9,173,928 B2 | 11/2015 | Matsumoto |
| 9,217,036 B2 | 12/2015 | Strittmatter et al. |
| 9,234,038 B2 | 1/2016 | Jung et al. |
| 9,242,013 B2 | 1/2016 | Howard et al. |
| 9,295,707 B2 | 3/2016 | Shashoua |
| 9,320,436 B2 | 4/2016 | Russmann et al. |
| 9,347,085 B2 | 5/2016 | Gan et al. |
| 9,382,316 B2 | 7/2016 | Yoon |
| 9,580,494 B2 | 2/2017 | Shafer et al. |
| 9,618,511 B2 | 4/2017 | Querfurth |
| 9,637,552 B2 | 5/2017 | Cashman et al. |
| 9,645,155 B2 | 5/2017 | Cai et al. |
| 9,737,505 B2 | 8/2017 | Denis et al. |
| 9,751,912 B2 | 9/2017 | Hoshi |
| 9,757,398 B2 | 9/2017 | Vigo et al. |
| 9,777,056 B2 | 10/2017 | Sigurdsson et al. |
| 9,790,253 B2 | 10/2017 | Shair et al. |
| 9,821,114 B2 | 11/2017 | Cabrera Aquino et al. |
| 9,879,076 B2 | 1/2018 | Samira et al. |
| 9,907,485 B2 | 3/2018 | Hartlep et al. |
| 9,933,440 B2 | 4/2018 | Goetzl |
| 9,937,248 B2 | 4/2018 | Arya |
| 9,999,624 B2 | 6/2018 | May et al. |
| 10,011,653 B2 | 7/2018 | Hayashi et al. |
| 10,028,962 B2 | 7/2018 | Brodney et al. |
| 10,117,895 B2 | 11/2018 | Monsonego |
| 10,131,708 B2 | 11/2018 | Nitsch et al. |
| 10,203,342 B2 | 2/2019 | Goetzl |
| 10,232,056 B2 | 3/2019 | Uchida et al. |
| 10,282,349 B2 | 5/2019 | Jaffee |
| 10,323,084 B2 | 6/2019 | Hillen et al. |
| 10,358,503 B2 | 7/2019 | Sigurdsson |
| 10,364,286 B2 | 7/2019 | Fog et al. |
| 10,377,834 B2 | 8/2019 | De Strooper et al. |
| 10,393,757 B2 | 8/2019 | Hashimoto et al. |
| 10,420,923 B1 | 9/2019 | Katz |
| 10,421,958 B2 | 9/2019 | Poma et al. |
| 10,472,414 B2 | 11/2019 | Christensen et al. |
| 10,473,672 B2 | 11/2019 | Lin et al. |
| 10,532,104 B2 | 1/2020 | Elmaleh |
| 10,570,196 B2 | 2/2020 | Ghochikyan et al. |
| 10,654,917 B2 | 5/2020 | Volker et al. |
| 10,662,226 B2 | 5/2020 | Nowick et al. |
| 10,662,239 B2 | 5/2020 | Groves et al. |

(56) References Cited

U.S. PATENT DOCUMENTS

| | | |
|---|---|---|
| 10,662,246 B2 | 5/2020 | Wisniewski et al. |
| 10,670,613 B2 | 6/2020 | Umek et al. |
| 10,718,785 B2 | 7/2020 | Pike et al. |
| 10,730,937 B2 | 8/2020 | Okazawa et al. |
| 10,738,107 B2 | 8/2020 | Gnauer et al. |
| 10,815,230 B2 | 10/2020 | Pike et al. |
| 10,815,469 B2 | 10/2020 | Poma et al. |
| 10,822,402 B2 | 11/2020 | Dengl et al. |
| 10,836,814 B2 | 11/2020 | Goshima et al. |
| 10,842,871 B2 | 11/2020 | Ferrero et al. |
| 10,851,156 B2 | 12/2020 | Mercken et al. |
| 10,859,582 B2 | 12/2020 | Sigurdsson et al. |
| 10,874,725 B2 | 12/2020 | Henco et al. |
| 10,888,600 B2 | 1/2021 | Tanzi et al. |
| 10,894,822 B2 | 1/2021 | Chain |
| 10,919,971 B2 | 2/2021 | Collinge et al. |
| 10,934,348 B2 | 3/2021 | Pedersen et al. |
| 10,941,205 B2 | 3/2021 | Duerr et al. |
| 10,941,215 B2 | 3/2021 | Dennis et al. |
| 10,954,306 B2 | 3/2021 | Greenfield et al. |
| 10,976,319 B2 | 4/2021 | Pugia |
| 10,981,989 B2 | 4/2021 | Eisenbach et al. |
| 10,988,528 B2 | 4/2021 | Sigurdsson |
| 11,084,873 B2 | 8/2021 | Shie et al. |
| 11,085,935 B2 | 8/2021 | Barthelemy et al. |
| 11,098,106 B2 | 8/2021 | Novák et al. |
| 11,111,290 B2 | 9/2021 | Pedersen et al. |
| 11,135,313 B2 | 10/2021 | Wilson et al. |
| 11,181,533 B2 | 11/2021 | Shi et al. |
| 11,214,835 B1 | 1/2022 | Patel et al. |
| 11,219,627 B2 | 1/2022 | Davis et al. |
| 11,236,155 B2 | 2/2022 | Van et al. |
| 11,278,620 B2 | 3/2022 | Liang et al. |
| 11,286,297 B2 | 3/2022 | Groves et al. |
| 11,312,751 B2 | 4/2022 | Poma et al. |
| 11,319,372 B2 | 5/2022 | Calzone et al. |
| 11,365,223 B2 | 6/2022 | Poma et al. |
| 11,370,833 B2 | 6/2022 | Le et al. |
| 11,389,476 B2 | 7/2022 | Eliaz |
| 11,395,796 B2 | 7/2022 | Romanelli et al. |
| 11,396,553 B2 | 7/2022 | Oostindie et al. |
| 11,413,282 B2 | 8/2022 | Sampath et al. |
| 11,427,638 B2 * | 8/2022 | Sun .................. A61P 35/00 |
| 11,434,302 B2 | 9/2022 | Raum et al. |
| 11,439,665 B2 | 9/2022 | Yao et al. |
| 11,446,398 B2 | 9/2022 | Barrett et al. |
| 11,459,404 B2 | 10/2022 | Bacac et al. |
| 11,459,405 B2 | 10/2022 | Sasisekharan et al. |
| 11,466,099 B2 | 10/2022 | Garcia et al. |
| 11,471,490 B2 | 10/2022 | Andresen et al. |
| 11,472,858 B2 | 10/2022 | Yao et al. |
| 11,478,554 B2 | 10/2022 | Lerchen et al. |
| 11,505,609 B2 | 11/2022 | Qin et al. |
| 11,512,137 B2 | 11/2022 | Oostindie et al. |
| 11,518,810 B2 | 12/2022 | Song et al. |
| 11,525,007 B2 | 12/2022 | Bruenker et al. |
| 11,535,838 B2 | 12/2022 | Rosenblum et al. |
| 11,583,594 B2 | 2/2023 | Xie |
| 11,584,793 B2 | 2/2023 | Dengl et al. |
| 11,590,128 B2 | 2/2023 | Sampath et al. |
| 11,596,699 B2 | 3/2023 | Fotin-Mleczek |
| 11,597,772 B2 | 3/2023 | Oestergaard et al. |
| 11,603,411 B2 | 3/2023 | Duerr et al. |
| 11,608,369 B2 | 3/2023 | Yao et al. |
| 11,608,376 B2 | 3/2023 | Georges et al. |
| 11,618,778 B2 | 4/2023 | Yao et al. |
| 11,633,430 B2 | 4/2023 | Yao et al. |
| 11,634,486 B2 | 4/2023 | Jefferies et al. |
| 11,654,143 B2 | 5/2023 | Hamdy et al. |
| 11,660,351 B2 | 5/2023 | Lerchen et al. |
| 11,666,642 B2 | 6/2023 | Suri et al. |
| 11,679,127 B2 | 6/2023 | Stubenrauch et al. |
| 11,685,714 B2 | 6/2023 | Lerchen et al. |
| 11,713,358 B2 | 8/2023 | Schellenberger et al. |
| 11,718,680 B2 | 8/2023 | Bacac et al. |
| 11,746,161 B2 | 9/2023 | Chen et al. |
| 11,753,466 B2 | 9/2023 | West et al. |
| 11,768,203 B2 | 9/2023 | Chaudhary |
| 11,771,696 B2 | 10/2023 | Hamdy et al. |
| 11,788,205 B2 | 10/2023 | Klein et al. |
| 11,833,214 B2 | 12/2023 | Hilderbrand et al. |
| 11,857,628 B2 | 1/2024 | Poma et al. |
| 11,866,507 B2 | 1/2024 | Eckelman |
| 11,867,696 B2 | 1/2024 | Schwartz |
| 11,873,332 B2 | 1/2024 | Soto et al. |
| 11,873,342 B2 | 1/2024 | Li et al. |
| 11,891,444 B2 | 2/2024 | Gauthier et al. |
| 11,912,759 B2 | 2/2024 | Liu et al. |
| 11,913,945 B2 | 2/2024 | Schaefer et al. |
| 2003/0133939 A1 | 7/2003 | Ledbetter et al. |
| 2004/0022397 A1 | 2/2004 | Warren |
| 2005/0032673 A1 | 2/2005 | John et al. |
| 2005/0158321 A1 | 7/2005 | Hurez et al. |
| 2006/0240551 A1 | 10/2006 | Jiang |
| 2006/0257359 A1 | 11/2006 | Francois et al. |
| 2009/0269779 A1 | 10/2009 | Raz et al. |
| 2009/0280116 A1 | 11/2009 | Smith et al. |
| 2009/0311193 A1 | 12/2009 | Mauro et al. |
| 2010/0061992 A1 | 3/2010 | Anderson et al. |
| 2010/0143954 A1 | 6/2010 | Muntendam |
| 2010/0196882 A1 | 8/2010 | Raz et al. |
| 2010/0330602 A1 | 12/2010 | Van Meir et al. |
| 2011/0038861 A1 | 2/2011 | Rosenthal et al. |
| 2011/0293608 A1 | 12/2011 | Jaffee |
| 2012/0225114 A1 | 9/2012 | Francois et al. |
| 2012/0253160 A1 | 10/2012 | Mauro et al. |
| 2013/0029900 A1 | 1/2013 | Widdison |
| 2013/0029955 A1 | 1/2013 | Muntendam |
| 2013/0323268 A1 | 12/2013 | Chari et al. |
| 2014/0086836 A1 | 3/2014 | Burnham et al. |
| 2014/0086932 A1 | 3/2014 | Traber |
| 2014/0099254 A1 | 4/2014 | Chang et al. |
| 2014/0235495 A1 | 8/2014 | Pugia |
| 2014/0286970 A1 | 9/2014 | Jeffrey et al. |
| 2014/0294868 A1 | 10/2014 | Howard et al. |
| 2015/0105539 A1 | 4/2015 | Miao et al. |
| 2015/0105540 A1 | 4/2015 | Miao et al. |
| 2015/0150945 A1 | 6/2015 | Francois et al. |
| 2015/0218274 A1 | 8/2015 | Sabatos-Peyton et al. |
| 2015/0301058 A1 | 10/2015 | Schettini et al. |
| 2015/0329636 A1 | 11/2015 | Dennis et al. |
| 2016/0068577 A1 | 3/2016 | Poma et al. |
| 2016/0177284 A1 | 6/2016 | Poma et al. |
| 2016/0376328 A1 | 12/2016 | Poma et al. |
| 2017/0002046 A1 | 1/2017 | Poma et al. |
| 2017/0014446 A1 | 1/2017 | Rolke et al. |
| 2017/0153241 A1 | 6/2017 | Pugia |
| 2017/0355756 A1 | 12/2017 | Julien |
| 2018/0000899 A1 | 1/2018 | Francois et al. |
| 2018/0243432 A1 | 8/2018 | Poma et al. |
| 2018/0256747 A1 | 9/2018 | Hawthorne et al. |
| 2018/0291359 A1 | 10/2018 | Poma et al. |
| 2019/0153044 A1 | 5/2019 | Poma et al. |
| 2019/0175649 A1 | 6/2019 | Novik |
| 2019/0218300 A1 | 7/2019 | Del Rio et al. |
| 2019/0248902 A1 | 8/2019 | Nioi |
| 2019/0265235 A1 | 8/2019 | Schwartz et al. |
| 2019/0374650 A1 | 12/2019 | Moon et al. |
| 2020/0024312 A1 | 1/2020 | Poma et al. |
| 2020/0055938 A1 | 2/2020 | Desai |
| 2020/0223921 A1 | 7/2020 | Sun et al. |
| 2021/0132067 A1 | 5/2021 | Schwartz |
| 2021/0324056 A1 | 10/2021 | Luthman et al. |
| 2021/0401985 A1 | 12/2021 | Biel et al. |
| 2022/0025071 A1 | 1/2022 | Capon |
| 2022/0088013 A1 | 3/2022 | Hamdy et al. |
| 2022/0088195 A1 | 3/2022 | Klein et al. |
| 2022/0098329 A1 | 3/2022 | Santich et al. |
| 2022/0125942 A1 | 4/2022 | Musick et al. |
| 2022/0127366 A1 | 4/2022 | Fotakis et al. |
| 2022/0133711 A1 | 5/2022 | Chari et al. |
| 2022/0135678 A1 | 5/2022 | Chaudhary |
| 2022/0162316 A1 | 5/2022 | Pandit et al. |
| 2022/0168418 A1 | 6/2022 | Haefel et al. |

(56) References Cited

U.S. PATENT DOCUMENTS

| | | |
|---|---|---|
| 2022/0184127 A1 | 6/2022 | Wang et al. |
| 2022/0195043 A1 | 6/2022 | Li et al. |
| 2022/0195057 A1 | 6/2022 | Li et al. |
| 2022/0195071 A1 | 6/2022 | Jones |
| 2022/0204582 A1 | 6/2022 | Chaudhary |
| 2022/0211696 A1 | 7/2022 | Sampath et al. |
| 2022/0211865 A1 | 7/2022 | Fischer et al. |
| 2022/0226514 A1 | 7/2022 | Vasiljeva et al. |
| 2022/0233705 A1 | 7/2022 | Le Scolan et al. |
| 2022/0242936 A1 | 8/2022 | Feng et al. |
| 2022/0242949 A1 | 8/2022 | Desnoyers et al. |
| 2022/0244271 A1 | 8/2022 | Reed et al. |
| 2022/0251231 A1 | 8/2022 | Oostindie et al. |
| 2022/0257762 A1 | 8/2022 | Liang et al. |
| 2022/0259306 A1 | 8/2022 | Duan et al. |
| 2022/0259321 A1 | 8/2022 | Cascino |
| 2022/0265642 A1 | 8/2022 | Sampath et al. |
| 2022/0267460 A1 | 8/2022 | Lansing et al. |
| 2022/0275067 A1 | 9/2022 | Dolan, III et al. |
| 2022/0281945 A1 | 9/2022 | Yao et al. |
| 2022/0288123 A1 | 9/2022 | Yao et al. |
| 2022/0289173 A1 | 9/2022 | Sun et al. |
| 2022/0289858 A1 | 9/2022 | Benatuil et al. |
| 2022/0306761 A1 | 9/2022 | Duerr et al. |
| 2022/0324940 A1 | 10/2022 | Yao et al. |
| 2022/0332757 A1 | 10/2022 | Zhang et al. |
| 2022/0340640 A1 | 10/2022 | Yao et al. |
| 2022/0340677 A1 | 10/2022 | Zhang et al. |
| 2022/0354938 A1 | 11/2022 | Poma et al. |
| 2022/0357340 A1 | 11/2022 | Brady et al. |
| 2022/0363255 A1 | 11/2022 | Concas |
| 2022/0370441 A1 | 11/2022 | Sampath et al. |
| 2022/0372142 A1 | 11/2022 | Baliga et al. |
| 2022/0372156 A1 | 11/2022 | Lechner et al. |
| 2022/0380473 A1 | 12/2022 | Sun et al. |
| 2022/0380480 A1 | 12/2022 | Lechner et al. |
| 2022/0389116 A1 | 12/2022 | Klein et al. |
| 2022/0389449 A1 | 12/2022 | Paul et al. |
| 2022/0396632 A1 | 12/2022 | Novobrantseva et al. |
| 2022/0402998 A1 | 12/2022 | Liu et al. |
| 2022/0403001 A1 | 12/2022 | Suri et al. |
| 2022/0403027 A1 | 12/2022 | Ast et al. |
| 2022/0411514 A1 | 12/2022 | Sun et al. |
| 2023/0036181 A1 | 2/2023 | Sun et al. |
| 2023/0039927 A1 | 2/2023 | Cascino |
| 2023/0046007 A1 | 2/2023 | Bauer et al. |
| 2023/0048390 A1 | 2/2023 | Liebowitz |
| 2023/0052521 A1 | 2/2023 | Bacac et al. |
| 2023/0074330 A1 | 3/2023 | Suri et al. |
| 2023/0074657 A1 | 3/2023 | Song et al. |
| 2023/0081117 A1 | 3/2023 | Oakes et al. |
| 2023/0082273 A1 | 3/2023 | Song et al. |
| 2023/0084763 A1 | 3/2023 | Chen et al. |
| 2023/0091653 A1 | 3/2023 | Bindman et al. |
| 2023/0094463 A1 | 3/2023 | Sun et al. |
| 2023/0094471 A1 | 3/2023 | Chari et al. |
| 2023/0099756 A1 | 3/2023 | Hirata et al. |
| 2023/0103667 A1 | 4/2023 | Muntendam et al. |
| 2023/0104705 A1 | 4/2023 | Yao et al. |
| 2023/0107479 A1 | 4/2023 | Muntendam |
| 2023/0121775 A1 | 4/2023 | Schellenberger et al. |
| 2023/0140802 A1 | 5/2023 | Chaudhary |
| 2023/0151104 A1 | 5/2023 | Yan et al. |
| 2023/0190638 A1 | 6/2023 | Romanelli et al. |
| 2023/0192884 A1 | 6/2023 | Raum et al. |
| 2023/0192898 A1 | 6/2023 | Zhou et al. |
| 2023/0197278 A1 | 6/2023 | Griffin et al. |
| 2023/0201364 A1 | 6/2023 | Pattabiraman et al. |
| 2023/0201365 A1 | 6/2023 | Kreft et al. |
| 2023/0203117 A1 | 6/2023 | Gorby et al. |
| 2023/0203169 A1 | 6/2023 | Qin et al. |
| 2023/0203199 A1 | 6/2023 | Wei et al. |
| 2023/0203467 A1 | 6/2023 | Rosenblum et al. |
| 2023/0203532 A1 | 6/2023 | Ilkow et al. |
| 2023/0212255 A1 | 7/2023 | Yao et al. |
| 2023/0212303 A1 | 7/2023 | Umana et al. |
| 2023/0212319 A1 | 7/2023 | Chaudhary |
| 2023/0220071 A1 | 7/2023 | Dengl et al. |
| 2023/0220113 A1 | 7/2023 | Garcia et al. |
| 2023/0220115 A1 | 7/2023 | Capon |
| 2023/0220116 A1 | 7/2023 | Capon |
| 2023/0221333 A1 | 7/2023 | Sandoval et al. |
| 2023/0226045 A1 | 7/2023 | Sampath et al. |
| 2023/0227553 A1 | 7/2023 | Wei et al. |
| 2023/0235075 A1 | 7/2023 | Chen et al. |
| 2023/0235092 A1 | 7/2023 | Wei et al. |
| 2023/0242613 A1 | 8/2023 | Yao et al. |
| 2023/0255959 A1 | 8/2023 | Sampath et al. |
| 2023/0256092 A1 | 8/2023 | Tanaka et al. |
| 2023/0265204 A1 | 8/2023 | Shao |
| 2023/0270875 A1 | 8/2023 | Hirata et al. |
| 2023/0272092 A1 | 8/2023 | Paller et al. |
| 2023/0279120 A1 | 9/2023 | Sun et al. |
| 2023/0285588 A1 | 9/2023 | Shahar et al. |
| 2023/0287040 A1 | 9/2023 | Schellenberger et al. |
| 2023/0287118 A1 | 9/2023 | Ast et al. |
| 2023/0295327 A1 | 9/2023 | Lee et al. |
| 2023/0295334 A1 | 9/2023 | Schellenberger et al. |
| 2023/0295336 A1 | 9/2023 | Eckelman et al. |
| 2023/0322935 A1 | 10/2023 | Chen et al. |
| 2023/0322950 A1 | 10/2023 | Darowski et al. |
| 2023/0324389 A1 | 10/2023 | Schellenberger et al. |
| 2023/0331839 A1 | 10/2023 | Jefferies et al. |
| 2023/0338559 A1 | 10/2023 | Lerchen et al. |
| 2023/0340155 A1 | 10/2023 | Chen et al. |
| 2023/0340160 A1 | 10/2023 | Ast et al. |
| 2023/0348600 A1 | 11/2023 | Timmer et al. |
| 2023/0348611 A1 | 11/2023 | Oestergaard |
| 2023/0348612 A1 | 11/2023 | Lin et al. |
| 2023/0348628 A1 | 11/2023 | Meux et al. |
| 2023/0348995 A1 | 11/2023 | Paulson et al. |
| 2023/0357431 A1 | 11/2023 | Darowski et al. |
| 2023/0365705 A1 | 11/2023 | Chen et al. |
| 2023/0366884 A1 | 11/2023 | Zettl et al. |
| 2023/0372479 A1 | 11/2023 | Bacac et al. |
| 2023/0381321 A1 | 11/2023 | Lyski et al. |
| 2023/0390338 A1 | 12/2023 | Stubenrauch et al. |
| 2023/0399414 A1 | 12/2023 | Oostindie et al. |
| 2023/0406930 A1 | 12/2023 | Ji et al. |
| 2023/0414750 A1 | 12/2023 | Filippou-Frye et al. |
| 2023/0416365 A1 | 12/2023 | Georges et al. |
| 2023/0416412 A1 | 12/2023 | Leclercq-Cohen et al. |
| 2024/0000776 A1 | 1/2024 | Sampath et al. |
| 2024/0002546 A1 | 1/2024 | Codarri et al. |
| 2024/0018204 A1 | 1/2024 | Kim et al. |
| 2024/0018260 A1 | 1/2024 | Schellenberger et al. |
| 2024/0026009 A1 | 1/2024 | Spriggs et al. |
| 2024/0033351 A1 | 2/2024 | Brunetta |
| 2024/0043379 A1 | 2/2024 | Lerchen et al. |
| 2024/0043535 A1 | 2/2024 | Amann et al. |
| 2024/0043554 A1 | 2/2024 | Maller et al. |
| 2024/0050562 A1 | 2/2024 | Fujimura et al. |
| 2024/0058443 A1 | 2/2024 | Haegel et al. |
| 2024/0059785 A1 | 2/2024 | Liu et al. |
| 2024/0059798 A1 | 2/2024 | Xu et al. |
| 2024/0158512 A1 | 5/2024 | Sun et al. |
| 2024/0182564 A1 | 6/2024 | Sun et al. |

FOREIGN PATENT DOCUMENTS

| | | |
|---|---|---|
| EP | 1 074 634 B1 | 2/2001 |
| EP | 0 651 809 B1 | 12/2001 |
| EP | 0 728 215 B1 | 2/2002 |
| EP | 0 817 969 B1 | 7/2002 |
| EP | 0 935 457 B1 | 1/2004 |
| EP | 0 610 254 B1 | 9/2004 |
| EP | 0 783 523 B1 | 10/2004 |
| EP | 0 792 458 B1 | 10/2004 |
| EP | 1 221 480 B1 | 5/2005 |
| EP | 0 846 171 B1 | 9/2005 |
| EP | 1 156 811 B1 | 12/2005 |
| EP | 1 490 692 B1 | 1/2006 |
| EP | 0 699 755 | 3/2006 |
| EP | 0 909 316 B1 | 8/2006 |

(56) References Cited

FOREIGN PATENT DOCUMENTS

| | | |
|---|---|---|
| EP | 0 890 105 B1 | 11/2006 |
| EP | 1 481 007 B1 | 1/2007 |
| EP | 1 161 524 B1 | 2/2007 |
| EP | 1 172 377 B1 | 4/2007 |
| EP | 1 697 370 B1 | 4/2007 |
| EP | 0 970 203 B1 | 5/2007 |
| EP | 1 379 546 B1 | 6/2007 |
| EP | 1 402 034 B1 | 6/2007 |
| EP | 1 485 410 B1 | 6/2007 |
| EP | 1 392 728 B1 | 8/2007 |
| EP | 1 516 189 B1 | 11/2007 |
| EP | 1 385 531 B1 | 5/2008 |
| EP | 1 781 644 B1 | 5/2008 |
| EP | 0 932 674 B1 | 7/2008 |
| EP | 1 379 882 B1 | 7/2008 |
| EP | 1 521 774 B1 | 8/2008 |
| EP | 1 353 691 B1 | 1/2009 |
| EP | 1 590 673 B1 | 4/2009 |
| EP | 1 623 719 B1 | 7/2009 |
| EP | 0 911 390 B1 | 8/2009 |
| EP | 0 966 533 B1 | 9/2009 |
| EP | 1 891 215 B1 | 10/2009 |
| EP | 1 497 661 B1 | 11/2009 |
| EP | 1 721 008 B1 | 2/2010 |
| EP | 1 180 938 B1 | 3/2010 |
| EP | 1 355 949 B1 | 3/2010 |
| EP | 1 797 123 B1 | 3/2010 |
| EP | 1 255 824 B1 | 4/2010 |
| EP | 1 423 704 B1 | 4/2010 |
| EP | 0 996 463 B1 | 5/2010 |
| EP | 1 596 809 B1 | 5/2010 |
| EP | 1 896 430 B1 | 11/2010 |
| EP | 1 891 241 B1 | 1/2011 |
| EP | 1 524 994 B1 | 4/2011 |
| EP | 1 404 710 B1 | 6/2011 |
| EP | 1 879 613 B1 | 11/2011 |
| EP | 1 885 886 B1 | 11/2011 |
| EP | 1 636 268 | 2/2012 |
| EP | 1 480 666 B1 | 6/2012 |
| EP | 1 554 311 B1 | 6/2012 |
| EP | 1 838 854 B1 | 10/2012 |
| EP | 2 297 196 B1 | 11/2012 |
| EP | 1 842 859 B1 | 1/2013 |
| EP | 2 185 592 B1 | 1/2013 |
| EP | 1 765 388 B1 | 4/2013 |
| EP | 2 240 602 B1 | 5/2013 |
| EP | 2 356 996 B1 | 6/2013 |
| EP | 2 380 583 B1 | 8/2013 |
| EP | 1 776 591 B1 | 10/2013 |
| EP | 2 165 714 B1 | 10/2013 |
| EP | 2 345 411 B1 | 10/2013 |
| EP | 1 670 943 B1 | 11/2013 |
| EP | 2 207 885 B1 | 11/2013 |
| EP | 2 364 719 B1 | 11/2013 |
| EP | 1 976 877 B1 | 1/2014 |
| EP | 2 423 311 B1 | 1/2014 |
| EP | 1 937 720 B1 | 4/2014 |
| EP | 2 182 983 B1 | 5/2014 |
| EP | 2 379 563 B1 | 7/2014 |
| EP | 1 678 505 B1 | 8/2014 |
| EP | 1 891 234 B1 | 12/2014 |
| EP | 2 354 795 B1 | 12/2014 |
| EP | 1 669 085 B1 | 1/2015 |
| EP | 2 365 976 B1 | 4/2015 |
| EP | 1 594 969 B1 | 5/2015 |
| EP | 1 781 703 B1 | 5/2015 |
| EP | 2 441 847 B1 | 9/2015 |
| EP | 1 420 032 B2 | 12/2015 |
| EP | 2 262 526 B1 | 12/2015 |
| EP | 2 470 211 B1 | 1/2016 |
| EP | 2 116 556 B1 | 3/2016 |
| EP | 2 500 361 B1 | 3/2016 |
| EP | 2 593 475 B1 | 3/2016 |
| EP | 2 454 599 B1 | 5/2016 |
| EP | 2 238 160 B1 | 6/2016 |
| EP | 2 330 113 B1 | 6/2016 |
| EP | 1 877 442 B1 | 8/2016 |
| EP | 2 443 149 B1 | 8/2016 |
| EP | 2 104 682 B1 | 9/2016 |
| EP | 2 011 513 B1 | 10/2016 |
| EP | 2 051 734 B1 | 10/2016 |
| EP | 2 842 967 B1 | 11/2016 |
| EP | 2 819 700 B1 | 12/2016 |
| EP | 2 694 124 B1 | 1/2017 |
| EP | 2 550 361 B1 | 2/2017 |
| EP | 2 462 161 B1 | 3/2017 |
| EP | 1 989 308 B1 | 5/2017 |
| EP | 2 207 568 B1 | 5/2017 |
| EP | 2 299 812 B1 | 7/2017 |
| EP | 2 149 584 B1 | 12/2017 |
| EP | 2 828 660 B1 | 12/2017 |
| EP | 2 463 368 B1 | 1/2018 |
| EP | 2 740 744 B1 | 3/2018 |
| EP | 3 043 802 B1 | 4/2018 |
| EP | 3 121 277 B1 | 4/2018 |
| EP | 2 514 823 B1 | 5/2018 |
| EP | 2 307 457 B1 | 6/2018 |
| EP | 2 356 144 B1 | 7/2018 |
| EP | 3 050 898 B1 | 8/2018 |
| EP | 3 056 510 B1 | 10/2018 |
| EP | 2 758 077 B1 | 12/2018 |
| EP | 2 802 602 B1 | 3/2019 |
| EP | 3466975 A1 * | 4/2019 ............. C07K 16/28 |
| EP | 2 994 160 B1 | 7/2019 |
| EP | 3 003 356 B1 | 7/2019 |
| EP | 3 066 475 B1 | 7/2019 |
| EP | 3 013 355 B1 | 8/2019 |
| EP | 2 789 695 B1 | 10/2019 |
| EP | 2 834 270 B1 | 10/2019 |
| EP | 2 961 426 B1 | 10/2019 |
| EP | 3 269 736 B1 | 11/2019 |
| EP | 3 339 323 B1 | 11/2019 |
| EP | 3 083 680 B1 | 1/2020 |
| EP | 3 164 152 B1 | 2/2020 |
| EP | 3 225 251 B1 | 2/2020 |
| EP | 2 814 963 B1 | 4/2020 |
| EP | 2 224 000 B1 | 5/2020 |
| EP | 2 831 584 B1 | 6/2020 |
| EP | 2 968 548 B1 | 9/2020 |
| EP | 3 324 186 B1 | 9/2020 |
| EP | 3 221 349 B1 | 11/2020 |
| EP | 2 448 968 B1 | 1/2021 |
| EP | 3 166 970 B1 | 3/2021 |
| EP | 3 436 010 B1 | 3/2021 |
| EP | 3 102 230 B1 | 4/2021 |
| EP | 3 197 445 B1 | 4/2021 |
| EP | 3 281 614 B1 | 6/2021 |
| EP | 2 408 807 B1 | 7/2021 |
| EP | 3 070 100 B1 | 7/2021 |
| EP | 3 353 214 B1 | 8/2021 |
| EP | 1 812 062 B1 | 3/2022 |
| EP | 4 129 335 A1 | 2/2023 |
| EP | 4 176 900 A1 | 5/2023 |
| EP | 4 186 926 A1 | 5/2023 |
| FR | 2994803 | 3/2014 |
| WO | WO 93/011161 | 6/1993 |
| WO | WO 94/013804 | 6/1994 |
| WO | WO 00/24782 | 5/2000 |
| WO | WO 02/026246 A2 | 4/2002 |
| WO | WO 05/033144 | 4/2005 |
| WO | WO 06/067198 A2 | 6/2006 |
| WO | WO 08/068048 | 6/2008 |
| WO | WO 08/085564 | 7/2008 |
| WO | WO 10/005858 A1 | 1/2010 |
| WO | WO 10/056722 A1 | 5/2010 |
| WO | WO 10/095042 A2 | 8/2010 |
| WO | WO 10/147969 A2 | 12/2010 |
| WO | WO 13/169890 | 11/2013 |
| WO | WO 14/140317 | 9/2014 |
| WO | WO 15/038426 | 3/2015 |
| WO | WO 15/117002 | 8/2015 |
| WO | WO 15/138438 | 9/2015 |
| WO | WO 16/004093 | 1/2016 |
| WO | WO 16/059453 A1 | 4/2016 |

(56) References Cited

FOREIGN PATENT DOCUMENTS

| | | |
|---|---|---|
| WO | WO 17/080973 | 5/2017 |
| WO | WO 18/058098 A1 | 3/2018 |
| WO | WO 18/115003 | 6/2018 |
| WO | WO 18/119351 | 7/2018 |
| WO | WO 18/129188 | 7/2018 |
| WO | WO 18/209276 | 11/2018 |
| WO | WO 19/023247 | 1/2019 |
| WO | WO 19/024784 A1 | 2/2019 |
| WO | WO 19/028357 | 2/2019 |
| WO | WO 19/074840 A1 | 4/2019 |
| WO | WO 19/079496 A2 | 4/2019 |
| WO | WO 19/084332 A1 | 5/2019 |
| WO | WO 19/089080 | 5/2019 |
| WO | WO 19/094679 A1 | 5/2019 |
| WO | WO 19/134481 A1 | 7/2019 |
| WO | WO 19/137922 A1 | 7/2019 |
| WO | WO 19/143125 A1 | 7/2019 |
| WO | WO 19/150183 A1 | 8/2019 |
| WO | WO 19/152895 | 8/2019 |
| WO | WO 19/161384 A1 | 8/2019 |
| WO | WO 19/165233 | 8/2019 |
| WO | WO 19/165240 A1 | 8/2019 |
| WO | WO 19/165421 | 8/2019 |
| WO | WO 19/168403 A2 | 9/2019 |
| WO | WO 19/173795 A2 | 9/2019 |
| WO | WO 19/186276 | 10/2019 |
| WO | WO 19/191518 A1 | 10/2019 |
| WO | WO 19/195621 | 10/2019 |
| WO | WO 19/198825 A1 | 10/2019 |
| WO | WO 19/207159 A1 | 10/2019 |
| WO | WO 19/222441 A1 | 11/2019 |
| WO | WO 19/243453 A1 | 12/2019 |
| WO | WO 19/246422 A1 | 12/2019 |
| WO | WO 20/023530 | 1/2020 |
| WO | WO 20/037258 A1 | 2/2020 |
| WO | WO 20/045646 A1 | 3/2020 |
| WO | WO 20/055975 A1 | 3/2020 |
| WO | WO 20/059847 A1 | 3/2020 |
| WO | WO 20/069621 A1 | 4/2020 |
| WO | WO 20/070225 A1 | 4/2020 |
| WO | WO 20/079244 A1 | 4/2020 |
| WO | WO 20/084346 A1 | 4/2020 |
| WO | WO 20/092107 A1 | 5/2020 |
| WO | WO 20/092202 A2 | 5/2020 |
| WO | WO 20/112889 | 6/2020 |
| WO | WO 20/117560 A1 | 6/2020 |
| WO | WO 20/123492 A1 | 6/2020 |
| WO | WO 20/138402 A1 | 7/2020 |
| WO | WO 20/139960 | 7/2020 |
| WO | WO 20/154475 | 7/2020 |
| WO | WO 20/160156 | 8/2020 |
| WO | WO 20/163730 A2 | 8/2020 |
| WO | WO 20/165453 A1 | 8/2020 |
| WO | WO 20/172621 | 8/2020 |
| WO | WO 20/185676 A1 | 9/2020 |
| WO | WO 20/219646 A1 | 10/2020 |
| WO | WO 20/219868 A1 | 10/2020 |
| WO | WO 20/225799 A2 | 11/2020 |
| WO | WO 20/257745 A1 | 12/2020 |
| WO | WO 20/263862 A1 | 12/2020 |
| WO | WO 20/264211 A1 | 12/2020 |
| WO | WO 21/002312 A1 | 1/2021 |
| WO | WO 21/007110 A1 | 1/2021 |
| WO | WO 21/011673 | 1/2021 |
| WO | WO 21/012082 A1 | 1/2021 |
| WO | WO 21/028590 A1 | 2/2021 |
| WO | WO 21/048619 A2 | 3/2021 |
| WO | WO 21/055583 A1 | 3/2021 |
| WO | WO 21/062361 A2 | 4/2021 |
| WO | WO 21/068879 A1 | 4/2021 |
| WO | WO 21/071830 A1 | 4/2021 |
| WO | WO 21/078942 A1 | 4/2021 |
| WO | WO 21/081101 A1 | 4/2021 |
| WO | WO 21/084274 A1 | 5/2021 |
| WO | WO 21/108809 A1 | 6/2021 |
| WO | WO 21/157634 A1 | 8/2021 |
| WO | WO 21/163346 A2 | 8/2021 |
| WO | WO 21/163681 A2 | 8/2021 |
| WO | WO 21/167723 A1 | 8/2021 |
| WO | WO 21/184404 A1 | 9/2021 |
| WO | WO 21/186079 A1 | 9/2021 |
| WO | WO 21/190558 A1 | 9/2021 |
| WO | WO 21/190562 A1 | 9/2021 |
| WO | WO 21/195770 A1 | 10/2021 |
| WO | WO 21/207273 A1 | 10/2021 |
| WO | WO 21/236809 A2 | 11/2021 |
| WO | WO 21/242545 A1 | 12/2021 |
| WO | WO 21/242776 | 12/2021 |
| WO | WO 21/248081 A1 | 12/2021 |
| WO | WO 21/256710 A1 | 12/2021 |
| WO | WO 21/260193 A1 | 12/2021 |
| WO | WO 22/005590 A1 | 1/2022 |
| WO | WO 22/026740 A1 | 2/2022 |
| WO | WO 22/031342 A1 | 2/2022 |
| WO | WO 22/032166 A1 | 2/2022 |
| WO | WO 22/060424 A1 | 3/2022 |
| WO | WO 22/060488 A1 | 3/2022 |
| WO | WO 22/072538 | 4/2022 |
| WO | WO 22/150642 | 7/2022 |
| WO | WO 22/150644 | 7/2022 |
| WO | WO 22/164886 | 8/2022 |
| WO | WO 22/178367 | 8/2022 |
| WO | WO 22/198232 | 9/2022 |
| WO | WO 22/200412 | 9/2022 |
| WO | WO 22/200478 | 9/2022 |
| WO | WO 22/200525 | 9/2022 |
| WO | WO 22/204282 | 9/2022 |
| WO | WO 22/212918 | 10/2022 |
| WO | WO 22/226100 | 10/2022 |
| WO | WO 22/231978 | 11/2022 |
| WO | WO 22/235622 | 11/2022 |
| WO | WO 22/240741 | 11/2022 |
| WO | WO 22/241148 | 11/2022 |
| WO | WO 22/241446 | 11/2022 |
| WO | WO 22/251850 | 12/2022 |
| WO | WO 22/253867 | 12/2022 |
| WO | WO 22/258015 | 12/2022 |
| WO | WO 22/258662 | 12/2022 |
| WO | WO 22/258673 | 12/2022 |
| WO | WO 22/258678 | 12/2022 |
| WO | WO 22/258691 | 12/2022 |
| WO | WO 22/261113 | 12/2022 |
| WO | WO 22/266539 | 12/2022 |
| WO | WO 22/266540 | 12/2022 |
| WO | WO 22/268050 | 12/2022 |
| WO | WO 22/268192 | 12/2022 |
| WO | WO 23/001884 | 1/2023 |
| WO | WO 23/288252 | 1/2023 |
| WO | WO 23/288267 | 1/2023 |
| WO | WO 23/019216 | 2/2023 |
| WO | WO 23/051727 | 4/2023 |
| WO | WO 23/056969 | 4/2023 |
| WO | WO 23/061388 | 4/2023 |
| WO | WO 23/068818 A1 | 4/2023 |
| WO | WO 23/077099 A1 | 5/2023 |
| WO | WO 23/086768 | 5/2023 |
| WO | WO 23/094413 A1 | 6/2023 |
| WO | WO 23/109942 | 6/2023 |
| WO | WO 23/116880 | 6/2023 |
| WO | WO 23/125611 | 7/2023 |
| WO | WO 23/138551 | 7/2023 |
| WO | WO 23/141611 | 7/2023 |
| WO | WO 23/153759 | 8/2023 |
| WO | WO 23/163187 | 8/2023 |
| WO | WO 23/166322 | 9/2023 |
| WO | WO 23/174396 | 9/2023 |
| WO | WO 23/180533 | 9/2023 |
| WO | WO 23/183923 | 9/2023 |
| WO | WO 23/196785 | 10/2023 |
| WO | WO 23/196786 | 10/2023 |
| WO | WO 23/196996 | 10/2023 |
| WO | WO 23/198195 | 10/2023 |
| WO | WO 23/198635 | 10/2023 |
| WO | WO 23/215674 | 11/2023 |

(56) References Cited

FOREIGN PATENT DOCUMENTS

| WO | WO 23/215740 | 11/2023 |
|---|---|---|
| WO | WO 23/227660 | 11/2023 |
| WO | WO 23/232752 | 12/2023 |
| WO | WO 24/001641 | 1/2024 |
| WO | WO 24/015830 | 1/2024 |
| WO | WO 24/026407 | 2/2024 |
| WO | WO 24/030577 | 2/2024 |
| WO | WO 24/036148 | 2/2024 |
| WO | WO 24/036329 | 2/2024 |
| WO | WO 24/040194 | 2/2024 |

OTHER PUBLICATIONS

Ashraf et al., Jun. 2018, Investigation of Gal-3 expression pattern in serum and cerebrospinal fluid of patients suffering from neurodegenerative disorders, Frontiers in Neuroscience, 12:Article 430, 8 pp.

Banks et al., Mar. 2007, Outcomes validity and reliability of the modified Rankin scale; implications for stroke clinical trials, Stroke, 38:1091-1096.

Barua et al., 2010, Effects of cigarette smoke exposure on clot dynamics and fibrin structure,: an ex vivo investigation, Arterioscler Thromb Vasc Biol, 30:75-79.

Benjamin et al., Mar. 7, 2017, Heart disease and stroke statistics—2017 update: a report from the American Heart Association, Circulation, 135:e146-e603.

Bio-techne, Feb. 7, 2018, Human galectin-3 antibody, product description, 1 p.

Blanchard et al, 2014, Galectin-3 inhibitors: a patent review (2008-present), Expert Opin. Ther. Patents, 24(10):1053-1065.

Boza-Serrano et al., Apr. 20, 2019, Galectin-3, a novel endogenous TREM2 ligand, detrimentally regulates inflammatory response in Alzheimer's disease, Acta Neuropathologica, 23 pp.

Brott et al., Jul. 1989, Measurements of acute cerebral infarction: a clinical examination scale, Stroke, 20(7):864-870.

Burguillos et al., Mar. 10, 2015 Microglia-secreted galectin-3 acts as a toll-like receptor 4 ligand and contributes to microglial activation, Cell Reports, 10:1626-1638.

Busby et al., 2016, Systematic comparison of monoclonal versus polyclonal antibodies for mapping histone modificaitons by ChIP-seq, Epigenetics & Chromatin, 9:49.

Carter et al., Dec. 2007, Heritability of clot formation, morphology, and lysis: the EuroCLOT study, Arterioscler Thromb Vasc Biol, 27:2783-2789.

Centers for Disease Control and Prevention, 2015, Report to Congress on traumatic brain injury in the United States, epidemiology and rehabilitation, National Center for Injury Prevention and Control; Division of Unintentional Injury Prevention, Atlanta, GA, 72 pp.

Chistiakov et al., 2017, The role of monocytosis and neutrophilia in atherosclerosis, J. Cell. Mol. Med, XX(X):1-17.

Collet et al., Nov. 2006, Altered fibrin architecture is associated with hypofribinolysis and premature coronary atherothrombosis, Arterioscler Thromb Vasc Biol, 26:2567-2573.

Corrado et al., 2010, An update on the role of markers of inflammation in atherosclerosis, Journal of Atherosclerosis and Thrombosis, 17(1):1-11.

De Pascalis et al., 2002, Grafting of abbreviated complementarity determining regions containing specificity determining residues essential for ligan contact to engineer a less immunogenic humanized monoclonal antibody, Journal of Immunology, 169:3076-3084.

Donkor, 2018, Stroke in the 21st century: a snapshot of the burden, epidemiology, and quality of life, Stroke Research and Treatment, vol. 2018, article ID 3238165, 10 pp.

Dunn et al., 2005, The influence of type 2 diabetes on fibrin structure and function, Diabetologia, 48:1198-1206.

Dunn et al., 2006, Molecular mechanisms involved in the resistance of fibrin to clot lysis by plasmin in subjects with type 2 diabetes mellitus, Diabetologia, 49:1071-1080.

Edwards et al., 2003, The remarkable flexibility of the human antibody repertoire, isolation of over one thousand different antibodies to a single protein, BLyS, J. Mol Biol., 334:103-118.

Fang et al., Sep. 2010, Trends in thrombolytic use for ischemic stroke in the United States, Journal of Hospital Medicine, 5(7):406-409.

Fatkhullina et al., 2016, The role of cytokines in the development of atherosclerosis, Biochemistry (Moscow), 81(11):1358-1370.

Freynhofer et al., 2012, The role of platelets in athero-thrombotic events, Current Pharmaceutical Design, 18:5197-5214.

Fugl-Meyer et al., 1975, The post-stroke hemiplegic patient, Scand J. Rehab Med, 7:13-31.

George et al., Aug. 2020, Pulmonary fibrosis and COVID-19: the potential role for antifibrotic therapy, The Lancet, 8:807-815.

Go et al., Jan. 21, 2014, Heart disease and stroke statistics—2014 update: a report from the American Heart Association, Circulation, 129:e28-e292.

Goel et al., 2004, Plasticity within the antigen-combining site may manifest as molecular mimicry in the humoral immune response, The Journal of Immunology, pp. 7358-7367.

Goldstein et al., Jun. 1989, Interrater reliability of the NIH stroke scale, Arch Neurol, 46:660-662.

Goplen et al., Apr. 14, 2020, Tissue-resident CD8+ T cells drive age-associated chronic lung sequelae following viral pneumonia, bioRxiv preprint doi: https://doi.org/10.1101/2020.04.13.041096, 46 pp.

Goulay et al., Nov. 28, 2019, From stroke to dementia: a comprehensive review exposing tight interactions between stroke and amyloid-β formation, Translational Stroke Research, 14 pp.

Green et al., 2005, Free radical trapping as a therapeutic approach to neuroprotection in stroke; experimental and clinical studies with NXY-059 and free radical scavengers, Current Drug Targets: CNS & Neurological Disorders, 4(2):109-118.

Guha et al., Mar. 26, 2013, Cod glycopeptide wih picomolar affinity to galectin-3 suppresses t-cell apoptosis and prostate cancer metastatis, PNAS, 110(13):5052-5057.

Hachinski et al., Sep. 2006, National Institute of Neurological Disorders and Stroke—Canadian Stroke Network Vascular Cognitive Impairment Harmonization Standards, Stroke, pp. 2220-2241.

Hunt, 2010 Mitochondrial and immunoallergic injury increase risk of positive drug rechallenge after drug-induced liver injury: a systematic review, Hepatology, 52(6):2216-2222.

Inoue et al., 2021, Current management and therapeutic strategies for cerebral amyloid angiopathy, International Journal of Molecular Sciences, 22:3869.

Jin et al., 2013 Spatial and temporal expression, and statin responsiveness of galectin-1 and galectin-3 in murine atherosclerosis, Korean Circulation Journal, pp. 223-230.

Kanyavus et al., Jun. 2019, Breaking the law: unconventional strategies for antibody diversification, Nature Reviews Immunology, 19:355-368.

Khan et al., 2014, Adjustable Locks and Flexible Keys: Plasticity of Epitope-Paratope Interactions in Germline Antibodies, J. Immunol. 192:5398-5405.

Leander et al., 2012, Impaired fibrinolytic capacity and increased fibrin formation associate with myocardial infarction, Blood Coagulation, Fibrinolysis and Cellular Haemostasis, Thrombosis and Haemostasis: 107(6):1092-1100.

Lee et al., 2013, Spatial and temporal expression, and status responsiveness of galectin-1 and galectin-3 in murine atherosclerosis, Korean Circulation Journal, 43:223-230.

Liu et al., 1996, Modulation of functional properties of galectin-3 by monoclonal antibodies binding to the non-lectin domains, Biochemistry, 35:6073-6079.

Liu et al., Jul. 21, 2020, Association of the total white blood cell, neutrophils, and monocytes count with the presence, severity, and types of carotid atherosclerotic plaque, Frontiers in Medicine, 7:Article 313, 10 pp.

Liu et al., May 4, 2020, Neutralizing antibodies isolated by a site-directed screening have potent protection on SARS-CoV-2 infection, bioRxiv preprint doi:https//doi.org/10.1101/2020.04.02.074914, 33 pp.

(56) References Cited

OTHER PUBLICATIONS

Lloyd et al., 2009, Modelling the human immune response: performance of a 1011 human antibody repertoire against a broad panel of therapeutically relevant antigens, Protein Engineering, Design & Selection, 22(3):159-168.

Loimaranta et al., 2018, Galectin-3-binding protein: a multitask glycoprotein with innate immunity functions in viral and bacterial infections, Journal of Leukocyte Biology, 104:777-785.

Lu et al., 2017, Modified citrus pectin inhibits galectin-3 function to reduce atherosclerotic lesions in apoE-deficient mice, Molecular Medicine Reports, 16:647-653.

MacKinnon et al., Mar. 1, 2012, Regulation of transforming growth factor-61-driven lung fibrosis by galectin-3, Am J Respir Crit Care Med, 185(5):537-546.

Madrigal-Matute, 2014, Galectin-3 a biomarker linking oxidative stress and inflammation with the clinical outcomes of patients with atherothrombosis, Journal of the American Heart Association, 114:1-13.

Mariuzza et al., 1987, The Structural Basis of Antigen-Antibody Recognition Annu. Rev. Biophys. Biophys. Chem., 16:139-159.

Martins et al., 2011, Targeting the insulin-like growth factor pathway in phabdomyosarcomas: rationale and future perspectives, Sarcoma, 2011:1-11.

McKee, 2014, Military-related traumatic brain injury and neurodegeneration, Alzheimer's & Dementia, 10:S242-S253.

Mehndiratta et al., Apr. 2012, Cerebral amyloid angiopathy-associated intracerebral hemorrhage: pathology and management, Neurosurg Focus, 32(4):E7, 14 pp.

Mills et al., 2002, Altered fibrin clot structure in the healthy relatives of patients with premature coronary artery disease, Circulation, 106:1938-1942.

Murphy et al., Dec. 2009, Plasticity during stroke recovery: from synapse to behavior, Nature Reviews, 10:861-872.

Nachtigal et al., May 1998, Galectin-3 expression in human atherosclerotic lesions, American Journal of Pathology, 152(5):1199-1208.

Nasreddine et al., Apr. 2005, The Montreal cognitive assessment, MoCA: a brief screening tool for mild cognitive impairment, JAGS, 53(4):695-699.

Nishikawa et al., 2018, Possible role of inflammation and galectin-3 in brain injury after subarachnoid hemorrhage, Brain Sci., 8:30, 11 pp.

O'Collins e al., 2006, 1,026 experimental treatments in acute stroke 59:467-477.

Osmancik et al., 2012, High leukocyte count and interleukin-10 predict high on-treatment-platelet-reactivity in patients treated with clopidogrel, J. Thromb Thrombolysis, 33:340-354.

Owens et al., 1994, The genetic engineering of monoclonal antibodies, Journal of Immunological Methods, 168:149-165.

Page et al., Jun. 2012, Clinically important differences for the upper-extremity Fugl-Meyer scale in people with minimal to moderate impairment due to chronic stroke, Physical Therapy, 92(6):791-798.

Papaspyridonos et al., 2008, Galectin-3 is an amplifier of inflammation in atherosclerotic plaque progression through macrophage activation and monocyte chemoattraction, Arterioscler Thromb Vasc Biol., 28:433-440.

Papay et al., 2009, Drug-induced liver injury following positive drug rechallenge, Regulatory Toxicology and Pharmacology, 54:84-90.

Paul et al., Aug. 6, 2007, Fibrin deposition accelerates neurovascular damage and neuroinflammation in mouse models of Alzheimer's disease, Journal of Experimental Medicine, 204(8):1999-2008.

Poosarla et al., 2017, Computational De Novo Design of Antibodies Binding to a Peptide With High Affinity, Biotech. Bioeng. 114(6):1331-1342.

Powers et al., 2018, 2018 guidelines for the early management of patients with acute ischemic stroke, Stroke, 49:e46-e99.

Pulgdellivol et al., Jun. 2020, Sialylation and galectin-3 in microglia-mediated neuroinflammation and neurodegeneration, Frontiers in Cellular Neuroscience, 14:Article 162, 11 pp.

Rasool et al., Nov. 9-12, 2021, Novel therapeutic efficacy of galectin-3 antibody for treating Alzheimer's disease, Conference Poster Brochure, Clinical Trials on Alzheimer's Disease, Boston, MA, p. 30.

Reijmer et al., May 6, 2015, Ischemic brain injury in cerebral amyloid angiopathy, Journal of Cerebral Blood Flow & Metabolism, 10 pp.

Rodrigues et al., 2018, The Edinburgh CT and genetic diagnostic criteria for lobar intracerebral haemorrhage associated with cerebral amyloid angiopathy: model development and diagnostic test accuracy study, Lancet Neurol, 17:232-240.

Sanford et al., Jul. 1993, Reliability of the Fugl-Meyer assessment for testing motor performance in patients following stroke, Physical Therapy, 73(7):447-454.

Satoh et al., 2011, Galectin-3 expression in delayed neuronal death of hippocampal CA 1 following transient forebrain ischemia, and its inhibition by hypothermia, Brain Research, 1382:266-274.

Scott et al., 2004, Genetic and environment determinants of fibrin structure and function: relevance to clinical disease, Arterioscler Thromb Vasc Biol, 24:1558-1566.

Shan et al., 2014, A new panel of blood biomarkers for the diagnosis of mild traumatic brain injury/concussion in adults, Journal of Neurotrauma, 30 pp.

Shen et al., 2016, The change of plasma galectin-3 concentrations after traumatic brain injury, Clinica Chimica Acta, 456:75-80.

Sun et al., Apr. 1, 2014, Myosin Va mediates Rab8A-regulated GLUT4 vesicle exocytosis in insulin-stimulated muscle cells, Molecular Biology of the Cell, 25:1159-1170.

Sun et al., Mar. 27, 2020, Macrophage galectin-3 enhances initimal translocation of vascular calcification in diabetes mellitus, Am J. Physiol Heart Circ Physiol, 318:H1068-H1079.

Toglia et al., May 2011, The mini-mental state examination and Montreal cognitive assessment in persons with mild subacute stroke: relationship to functional outcome, Arch Phys Med Rehabil, 92:792-798.

Tunduguru et al., Sep. 25, 2017, The actin-related p41ARC subunit contributes to p21-activated kinase-1 (PAK1)-mediated glucose uptake into skeletal muscle cells, J. Biol. Chem., 292(46):19034-19043.

Undas et al., 2007, Altered fibrin clot structure in patients with advanced coronary artery disease: a role of c-reactive protein, lipoprotein(a) and homocysteine, J Thromb Haemost, 5:1988-1990.

Undas et al., 2008, Altered fibrin clot properties in patients on long-term haemodialysis: relation to cardiovascular mortality, 23:2010-2015.

Undas et al., 2008, Reduced clot permeability and susceptibility to lysis in patients with acute coronary syndrome: effects of inflammation and oxidative stress, Atherosclerosis, 196:551-557.

Van Swieten et al., May 1988, Interobserver agreement for the assessment of handicap in stroke patients, Stroke, 19(5):604-697.

Varsateh et al., 2021, Imaging atherosclerotic plaques by targeting galectin-3 and activate macrophages using ($^{89}$Zr)-DFO-Galectin3-F(ab')$_2$ mAb, Theranostics, 11(4):1864-1876.

Veerbeek et al., Feb. 2014, What is the evidence for physical therapy poststroke? A systematic review and meta-analysis, PLOS One, 9(2):e87987.

Virani et al., Mar. 3, 2020, Heart disease and stroke statistics—2020 update: a report from the American Heart Association, Circulation, 141:e139-e596.

Viswanathan et al., 2011, Cerebral amyloid angiopathy in the elderly, Ann Neurol, 70:871-880.

Wang et al., 2013, Elevated galectin-3 levels in the serum of patients with Alzheimer's disease, American Journal of Alzheimer's Disease & Other Dementias, 4 pp.

Wang et al., Apr. 19, 2021, Galectin-3 mediated inflammatory response contributes to neurological recovery by QiShenYiQi in subacute stroke model, Frontiers in Pharmacology; 12:Article 588587, 16 pp.

(56) References Cited

OTHER PUBLICATIONS

Wang et al., Mar. 12, 2020, A human monoclonal antibody blocking SARS-CoV-2 infections, bioRxiv, https://biorxiv.org/content/10.1101/2020.03.11.987958v1, 24 pp.
Weisel et al., Jan. 10, 2013, Mechanisms of fibrin polymerization and clinical implications, Blood, 31 pp.
Yan et al., 2009, Galectin-3 mediates post-ischemic tissue remodeling, Brain Research, 1288:116-124.
Yip et al., 2017, Galectin-3 released in response to traumatic brain injury acts as an alarmin orchestrating brain immune response and promoting neurodegeneration, Scientific Reports, 7:41689, 13 pp.
Yoo et al., 2008, Undernutrition as a predictor of poor clinical outcomes in acute ischemic stroke patients, Arch Neurol, 61(1):39-43.
International Search Report and Written Opinion dated Jan. 6, 2022 in Application No. PCT/US21/034096.
Agarwal et al., Jan. 2, 2013, A Pictet-Spengler ligation for protein chemical modification, PNAS, 110(1): 46-51.
Axup et al., Oct. 2, 2012, Synthesis of site-specific antibody-drug conjugates using unnatural amino acids, PNAS 109(40):16101-16106.
Baines et al., 1992, Purification of Immunoglobulin G (IgG), in Methods in Molecular Biology, 10:79-104, The Humana Press, Inc., Totowa, NJ.
Bird et al., Oct. 12, 1988, Single-Chain Antigen-Binding Proteins. Science, 242(4877):423-426.
Blaney, et al., 2002, Traceless solid-phase organic synthesis, Chem. Rev. 102:2607-2024.
Brinkmann et al., 2017, The making of bispecific antibodies, MABS, 9(2):182-212.
Carter, May 2006, Potent antibody therapeutics by design. Nat. Rev. Immunol., 6(5):343-357.
Casi et al., 2012, Site-specific traceless coupling of potent cytotoxic drugs to recombinant antibodies for pharmacodelivery, JACS 134(13):5887-5892.
Cedeno-Laurent et al. Dec. 2012, Galectins and their Ligands: Negative Regulators of Anti-Tumor Immunity. Glycoconjugate Journal. 29(8-9):619-625.
Chatal et al., 1985, Clinical prospective study with radiolodinated monoclonal antibodies directed against colorectal cancer, Monoclonal Antibodies for Cancer Detection and Therapy, Baldwin and Byers eds., pp. 159-180, 223-267, Academic Press.
Chothia et al., 1987, Canonical structures for the hypervariable regions of immunoglobulins, J Mol Biol, 196(4):901-917.
Chothia et al., 1989, Conformations of immunoglobulin hypervariable regions, Nature, 342:877-883.
Cortez-Retamozo et al., Apr. 15, 2004, Efficient cancer therapy with a nanobody-based conjugate, Cancer Research, 64:2853-2857.
Dawson et al., May 14, 1997, Modulation of Reactivity in Native Chemical Ligation through the Use of Thiol Additives, J. Am. Chem. Soc. 119(19):4325-4329.
Dawson et al., Nov. 4, 1994, Synthesis of proteins by native chemical ligation, Science, 266:776-779.
Ebrahim et al., Sep. 2014, Galectins in cancer: carcinogenesis, diagnosis and therapy, Annals of Translational Medicine, 2(9):88.
Fredericks et al., 2004, Identification of potent human anti-IUL-IR1, antagonist antibodies, Protein Engineering, Design & Selection, 17(1):95-106.
Glaser et al., Oct. 15, 1992, Dissection of the combining site in a humanized anti-tax antibody, J. Immunol. 149:2607-2614.
Green et al., May 1994, Antigen-specific human monoclonal antibodies from mice engineered with human Ig heavy and light chain YACs. Nat. Genet. 7(1):13-21.
Gump et al., 2001, An antibody to p16INK4A recognizes a modified form of galectin-3, Hybridoma, 20(3):167-174.
Hackeng et al., Aug. 1999, Protein synthesis by native chemical ligation: Expanded scope by using straightforward methodology., Proc. Natl. Acad. Sci. USA, 96:10068-10073.
Hejesen et al., 2013, A traceless aryl-triazene linker for DNA-directed chemistry, Org Biomol Chem, 11(15):2493-2497.
Holliger et al., Jul. 1993, Diabodies: small bivalent and bispecific antibody fragments. PNAS, 90:6444-6448.
Holliger et al., Sep. 2005, Engineered antibody fragments and the rise of single domains. Nat. Biotechnol. 23(9):1126-1136.
Huang et al., Oct. 2014, CEACAM1 regulates TIM-3-mediated tolerance and exhaustion. Nature. 517(7534):386-390.
Huston et al. Aug. 1988, Protein engineering of antibody binding sites: Recovery of specific activity in an anti-digoxin single-chain Fv analogue produced in *Escherichia coli*, PNAS, 85:5879-5883.
Johnson et al., 2000, Kabat database and its applications: 30 years after the first variability plot, Nucleic Acids Res., 28(1):214-218.
Kang et al., Jun. 2018, Imaging-based tumor treatment response evaluation: Review of conventional, new and emerging concepts. Korean J. Radiol. 13(4):371-390.
Kohler et al., Aug. 7, 1975, Continuous cultures of fused cells secreting antibody of predefined specificity. Nature. 256:495-497.
Korndorfer et al., 2003, Crystallographic analysis of an "anticalin" with tailored specificity for fluorescein reveals high structural plasticity of the lipocalin loop region, Proteins: Structure, Function, and Bioinformatics, 53(1):121-129.
Kunik et al., 2012, Paratome: an online tool for systematic identification of antigen-binding regions in antibodies based on sequence or structure, Nucl Acids Res., 40:W521-W524.
Lam, 1997, Application of combinatorial library methods in cancer research and drug discovery, Anticancer Drug Des. 12:145-167.
Larrick et al., May 15, 1989, Rapid cloning of rearranged immunoglobulin genes from human hybridoma cells using mixed primers and the polymerase chain reactions, Biochem. Biophys. Res. Commun., 160(3):1250-1255.
Lefranc et al., 2003, IMGT unique numbering for immunoglobulin and T cell receptor variable domains and Ig superfamily V-like domains, Dev Comp Immunol. 27:55-77.
Leitner, J et al. TIM-3 Does Not Act as a Receptor for Galectin-9. PLoS Pathog. Mar. 2013. 9(3):e1003253.
Leung et al., Dec. 1994, Chimerization of LL2, a rapidly internalizing antibody specific for B cell lymphoma. Hybridoma. 13(6):469-476.
Levitt et al., 1983, Molecular dynamics of native protein I. Computer simulation of trajectories, J. Mol. Biol., 168:595-620.
Li, P et al. Design and Synthesis of Paclitaxel Conjugated with an ErbB2-Recognizing Peptide, EC-1. Biopolymers. Nov. 2007; 87(4):225-30.
Linch et al., Nov. 4, 2015, Galectin-3 inhibition using novel inhibitor GR-MD-02 improves survival and immune function while reducing tumor vasculature, Journal for Immunotherapy of Cancer, 3(Suppl 2):P306.
Liu et al. Feb. 2007, Synthesis of 2'-paclitaxel methyl 2-glucopyranosyl succinate for specific targeted delivery to cancer cells. Bioorg. Med. Chem. Lett., 17(3):617-620.
Lonberg et al., Apr. 1994, Antigen-specific human antibodies from mice comprising four distinct genetic modifications. Nature. 368(6474):856-859.
MacCallum et al., 1996, Antibody-antigen interactions; contact analysis and binding site topography, J. Mol. Biol., 5:732-745.
Makabe et al., Jan. 11, 2008, Thermodynamic consequences of mutations in vernier zone residues of a humanized anti-human epidermal growth factor receptor murine antibody, 528, Journal of Biological Chemistry, 283(2):1156-1166.
Martin et al., Dec. 1989, Modeling antibody hypervariable loops; a combined algorithm, Proc Natl Acad Sci (USA), 86:9268-9272.
McCafferty et al., Dec. 1990, Phage antibodies: filamentous phage displaying antibody variable domains. Nature, 348(6301):552-554.
Olafsen et al., 2004, Characterization of engineered anti-p185$^{HER-2}$ (scFv-$C_H$3)$_2$ antibody fragments (minibodies) for tumor targeting, Protein Eng Des Sel., 17(4):315-323.
Olsnes et al., 1982, Chimeric Toxins, Pharmac. Ther. 15:355-381.
Orlandi et al., May 1989, Cloning immunoglobulin variable domains for expression by the polymerase chain reaction, Proc. Natl. Acad. Sci. U.S.A., 86: 3833-3837.
Powers et al., 2001, Expression of single-chain Fv-Fc fusions in pichia pastoris, Journal of Immunological Methods, 251:123-135.

(56) References Cited

OTHER PUBLICATIONS

Redmond, Feb. 7, 2017, Immunotherapy plus a galectin-3 inhibitor improves anti-tumor immunity: insights from mice in a first-in-human phase I clinical trial, Earle A. Chiles Research Institute, 33 pp.
Roque et al., 2004, Antibodies and genetically engineered related molecules: production and purification, Biotechnol. Prog. 20:639-654.
Samudrala et al., 1999, Ab Initio Protein Structure Prediction Using a Combined Hierarchical Approach, Proteins, Structure, Function and Genetics Suppl., 3:194-198.
Sastry et al., 1989, Cloning of the immunological repertoire in *Escherichia coli* for generation of monoclonal catalytic antibodies: construction of a heavy chain variable region-specific cDNA library. Proc. Natl. Acad. Sci., U.S.A. 86: 5728-5732.
Shalaby et al.,1992, Development of humanized bispecific antibodies reactive with cytotoxic lymphocytes and tumor cells overexpressing the HER2 protooncogene, J. Exp. Med. 175:217-225.
Strop et al., 2013, Location matters: site of conjugation modulates stability and pharmacokinetics of antibody drug conjugates, Chemistry and Biology, 20(2):161-167.
Swartz et al., Mar. 2012, Tumor Microenvironment Complexity: Emerging Roles in Cancer Therapy. Cancer Research. 72(10);2473-2480.
Takaya et al., Jan. 1998, Importance of dissolution process on systemic availability of drugs delivered by colon delivery system. J Control Release. 50(1-3):111-122.
Tao et al., 2020, Galectin-3 promotes Aβ oligomerization and Aβ toxicity in a mouse model of Alzheimer's disease, Cell Death & Differentiation, 27:192-209.
Tempest et al., Mar. 1991, Reshaping a human monoclonal antibody to inhibit human respiratory syncytial virus infection in vivo, Biotechnology 9:266-271.
Thijssen et al., Oct. 15, 2007, Galectins in the tumor endothelium: opportunities for combined cancer therapy, Blood, 119(0):2819-2827.
Thomas et al., Sep. 12, 2018, Galectin-3 mediated glial crosstalk drives oligodendrocyte differention and (re)myelination, Frontiers in Cellular Neuroscience, 12(12):1-16.
Tomlinson et al., 2000, Methods for Generating Multivalent and Bispecific Antibody Fragments. Methods Enzymol. 326:461-479.
Vuong et al., Apr. 1, 2019, An orally active galectin-3 antagonist inhibits lung adenocarcinoma growth and augments response to PD-L1 blockade, Cancer Research, 79(7):1480-1492.
Ward et al. Oct. 12, 1989, Binding aciivities of a repertoire of single immunoglobulin variable domains secreted fom *Escherichia coli*. Nature. 341:544-548.
Wu et al., Mar. 3, 2009, Site-specific chemical modification of recombinant proteins produced in mammalian cells by using the genetically encoded aldehyde tag. PNAS, 106(9):3000-3005.
Wu, et al. 2006, Building complex glycopeptides: Development of a cysteine-free native chemical ligation protocol, Angew. Chem. Int. Ed. 45:4116-4125.
Xiong et al., 2020, Transcriptomic characteristics of bronchoalveolar lavage fluid and peripheral blood mononuclear cells in COVID-19 patients, Emerging Microbes & Infections, 9:761-770.
Yip et al., Jan. 27, 2017, Galectin-3 released in response to traumatic brain injury acts as an alarmin orchestrating brain immune response and promoting neurodegeneration, Sci. Rep. 27, 13 pp.
Zapata et al., 1995, Engineering linear F(ab')$_2$ fragments for efficient production in *Escherichia coli* and enhanced antiproliferative activity, Protein Eng., 8(10):1057-1062.
Zhu et al., Nov. 13, 2005, The Tim-3 ligand galectin-9 negatively regulates T helper type 1 immunity, Nature Immunology, 6(12):1245-1252.
Al Gwairi et al., 2016, Cellular and molecular pathology of age-related macular degeneration: potential role for proteoglycans, Journal of Ophthalmology, vol. 2016, Article ID 2913612, 7 pp.
Translation of third office action in Chinese Application No. 202080025814.4.

Decision of Refusal dated Oct. 22, 2024 in Japanese patent application No. 2021-544701.
Extended European search report dated Oct. 10, 2024 in application No. 21812182.0.
International Search Report and Written Opinion dated Aug. 12, 2024 in Application No. PCT/US2024/024810.
Abcam, Sep. 27, 2023, Anti-Galectin 3 antibody [A3A12] ab2785, product data sheet, 7 pp.
Almagro et al., Jan. 1, 2008, Humanization of antibodies. Front Biosci., 13:1619-1633.
Boguslawa et al., Dec. 12, 2019, TGF-β and microNRA interpaly in genitourinary cancers, Cells, 8:1619, 40 pp.
Cerel et al., 2019, Inhibition of sialidase activity and galectin binding reduced xenogeneic neutrophil-endothelial adhesion, American Journal of Transplantation, 19(Supplement 3), abstract only, 2 pp.
Chammas, 2013, Cell Adhesion and Cancer Group. Tumors as complex organs: are cancers manageable through the modification of their microenvironment?. BMC Proc, 7(Suppl 2):K16.
Chen et al., Jun. 15, 1995, Enhancement and destruction of antibody function by somatic mutation: unequal occurrence is controlled by V gene combinatorial associations, EMBO J., 14(12)2784-2794.
De Oliveira et al., 2010, Platelet-activating factor receptor (PAF-R)-dependent pathways control tumour growth and tumour response to chemotherapy. BMC Cancer, 10:200.
Fichorova et al., Jan. 8, 2016, Trichomonas vaginalis lipophosphoglycan exploits binding to galectin-1 and -3 to modulate epithelial immunity, J. Biol. Chem, 291(2):998-1013.
Glinskii et al. Mechanical entrapment is insufficient and intercellular adhesion is essential for metastatic cell arrest in distant organs. Neoplasia. May 2005; 7(5), 522-527.
Greenspan et al., Oct. 1999, Defining epitopes: it's not as easy as it seems, Nature Biotechnology, 17(10):936-937.
Herold et al., Sep. 2017, Determinants of the assembly and function of antibody variable domains, Scientific Reports, 7:12276, 17 pp.
Koenig et al. Jan. 5, 2017, Mutational landscape of antibody variable domains reveals a switch modulating the interdomain conformational dynamics and antigen binding, PNAS, 114(4):E486-E495.
Kranz et al., Sep. 1981, Restricted reassociation of heavy and light chains from hapten-specific monoclonal antibodies, PNAS, 78(9):5807-5811.
Kussie et al., Jan. 1, 1994, A single engineered amino acid substitution changes antibody fine specificity.J Immunol., 152(1):146-152.
Li et al., Nov. 3, 2016, Hematopoietic-derived galectin-3 causes cellular and systemic insulin resistance, Cell, 167(4):973-984.
Linden et al., 2013, The role of galectin-3 in phagocytosis of Candida albicans and Candida parapsilosis by human neutrophils, Cellular Microbiology, 15(7):1127-1142.
Priglinger et al., Jul. 29, 2013, Galectin-3 induced clustering of CD147 and integrin-beta 1 transmembrane glycoprotein receptors on the RPE cell surface, Plos One, Article e70011, abstract only.
Razpotnik et al., Sep. 25, 2017, Targeting Malignant Brain Tumors with Antibodies. Front Immunol. 8:1181.
Shi et al., 2019, 032-II-1b is essential for anti-galectin3 antibody induced cutaneous vasculitis in systems lupus erythematosus, Journal of Investigative Dermatology, 2019 Meeting Abstract Supplement, 2 pp.
Volarevic et al., 2015, Gal-3 regulates the capacity of dendritic cells to promote NKT-cell-induced liver injury, European Journal of Immunology, 45:531-543.
Xu et al., Recent developments in galectin-3 and its inhibitors. Chinese Journal of Biochemical Pharmaceutics. Dec. 2011; 32(5), 417-420.
Yamamoto-Sugitani et al. 2011, Galectin-3 (Gal-3) induced by leukemia microenvironment promotes drug resistance and bone marrow lodgment in chronic myelogenous leukemia. PNAS 108(42):17468-17473.
Office action dated Aug. 6, 2024, in U.S. Appl. No. 18/354,611.
Examination Report No. 1 dated Jun. 21, 2024 in Australian patent application No. 2018308088.

(56) References Cited

OTHER PUBLICATIONS

Requisition by the examiner dated Oct. 27, 2023 in Canadian patent application No. 3,070,446.
Decision of Rejection dated Mar. 15, 2023 in Japanese patent application No. 2020-527838.
Notice of Reasons for Refusal dated Jun. 25, 2024 in Japanese patent application No. 2023-118382.
First Office Action and Search Report dated Mar. 1, 2023 in Chinese Application No. 2018800616946.6.
Second Office Action and Search Report dated Jul. 31, 2023 in Chinese Application No. 2018800616946.6.
Third Office Action dated Dec. 21, 2023 in Chinese Application No. 2018800616946.6.
Translation of Decision of Rejection in Chinese patent application No. 2018800616946.6.
Office action dated Jan. 5, 2024 in U.S. Appl. No. 17/813,578.
Requisition by the examiner dated Oct. 19, 2023 in Canadian patent application No. 3,127,113.
First Office Action and Search Report dated Jun. 15, 2023 in Chinese Application No. 202080025814.4.
Translation of decision of rejection in Chinese Application No. 202080025814.4.
Translation of second office action in Chinese Application No. 202080025814.4.
First Office Action dated Jul. 6, 2023 in Chinese Application No. 202211069802.9.
Translation of second office action in Chinese Application No. 202211069802.9.
Translation of decision of rejection in Chinese Application No. 2022113436441.
European Search Report dated Nov. 29, 2022 in patent application No. 20749738.9, 21 pp.
Examination Report dated Dec. 12, 2023 in patent application No. 20749738.9.
Notice of Reasons for Refusal dated Jan. 16, 2024 in Japanese patent application No. 2021-544701.
Requisition by the examiner dated Oct. 18, 2023 in Canadian patent application No. 3,164,060.
Partial supplemental European search report dated Aug. 17, 2023 in application No. 20896254.8.
Extended supplemental European search report dated Nov. 17, 2023 in application No. 20896254.8.
Partial supplemental European search report dated Jun. 11, 2024 in application No. 21812182.0.
Office action dated Feb. 1, 2023 in U.S. Appl. No. 17/812,159.
Office action dated Jul. 6, 2023 in U.S. Appl. No. 17/812,159.
Office action dated Jan. 24, 2024 in U.S. Appl. No. 17/812,159.
Office action dated Jun. 20, 2024 in U.S. Appl. No. 17/812,159.
Office action dated Jul. 12, 2024 in U.S. Appl. No. 17/812,159.
Requisition by the examiner dated Oct. 20, 2023 in Canadian patent application No. 3,166,552.
Translation of First Office Action dated Apr. 28, 2024 in Chinese patent application No. 202180022171.2.
Partial supplementary European search report dated Jul. 15, 2024 in patent application No. 21741281.6.
Office action dated Jan. 13, 2023 in U.S. Appl. No. 17/834,703.
Office action dated Feb. 2, 2024 in U.S. Appl. No. 17/834,703.
Office action dated Jul. 29, 2024 in U.S. Appl. No. 17/834,703.
International Search Report and Written Opinion dated Nov. 30, 2022 in Application No. PCT/US22/073694.
International Search Report and Written Opinion dated Mar. 14, 2024 in Application No. PCT/US23/75268.

* cited by examiner

Amino acid sequence of Gal3 and target proteins

| PROTEIN | SEQ ID NO | SEQUENCE |
|---|---|---|
| Human galectin-3 Isoform 1 (homo sapiens) NCBI Ref. No.: NP_002297.2 | 1 | MADNFSLHDALSGSGNPNPQGWPGAWGNQPAGAGGYPGASYPGA YPGQAPPGAYPGQAPPGAYPGAPGAYPGAPAPGVYPGPPSGPGAY PSSGQPSATGAYPATGPYGAPAGPLIVPYNLPLPGGVVPRMLITILG TVKPNANRIALDFQRGNDVAFHFNPRFNENNRRVIVCNTKLDNNW GREERQSVFPFESGKPFKIQVLVEPDHFKVAVNDAHLLQYNHRVK KLNEISKLGISGDIDLTSASYTMI |
| Human galectin-3 Isoform 3 (homo sapiens) NCBI Ref. No.: NP_001344607.1 | 2 | MHSKTPCGCFKPWKMADNFSLHDALSGSGNPNPQGWPGAWGNQP AGAGGYPGASYPGAYPGQAPPGAYPGQAPPGAYPGAPGAYPGAPA PGVYPGPPSGPGAYPSSGQPSATGAYPATGPYGAPAGPLIVPYNLPL PGGVVPRMLITILGTVKPNANRIALDFQRGNDVAFHFNPRFNENNR RVIVCNTKLDNNWGREERQSVFPFESGKPFKIQVLVEPDHFKVAVN DAHLLQYNHRVKKLNEISKLGISGDIDLTSASYTMI |
| SARS-CoV-2 spike (S) protein NCBI Ref No.: QHD43416.1 | 819 | MFVFLVLLPLVSSQCVNLTTRTQLPPAYTNSFTRGVYYPDKVFRSS VLHSTQDLFLPFFSNVTWFHAIHVSGTNGTKRFDNPVLPFNDGVYF ASTEKSNIIRGWIFGTTLDSKTQSLLIVNNATNVVIKVCEFQFCNDPF LGVYYHKNNKSWMESEFRVYSSANNCTFEYVSQPFLMDLEGKQG NFKNLREFVFKNIDGYFKIYSKHTPINLVRDLPQGFSALEPLVDLPIG INITRFQTLLALHRSYLTPGDSSSGWTAGAAAYYVGYLQPRTFLLK YNENGTITDAVDCALDPLSETKCTLKSFTVEKGIYQTSNFRVQPTES IVRFPNITNLCPFGEVFNATRFASVYAWNRKRISNCVADYSVLYNS ASFSTFKCYGVSPTKLNDLCFTNVYADSFVIRGDEVRQIAPGQTGKI ADYNYKLPDDFTGCVIAWNSNNLDSKVGGNYNYLYRLFRKSNLKP FERDISTEIYQAGSTPCNGVEGFNCYFPLQSYGFQPTNGVGYQPYRV VVLSFELLHAPATVCGPKKSTNLVKNKCVNFNFNGLTGTGVLTESN KKFLPFQQFGRDIADTTDAVRDPQTLEILDITPCSFGGVSVITPGTNT SNQVAVLYQDVNCTEVPVAIHADQLTPTWRVYSTGSNVFQTRAGC LIGAEHVNNSYECDIPIGAGICASYQTQTNSPRRARSVASQSIIAYTM SLGAENSVAYSNNSIAIPTNFTISVTTEILPVSMTKTSVDCTMYICGD STECSNLLLQYGSFCTQLNRALTGIAVEQDKNTQEVFAQVKQIYKT PPIKDFGGFNFSQILPDPSKPSKRSFIEDLLFNKVTLADAGFIKQYGD CLGDIAARDLICAQKFNGLTVLPPLLTDEMIAQYTSALLAGTITSGW TFGAGAALQIPFAMQMAYRFNGIGVTQNVLYENQKLIANQFNSAIG KIQDSLSSTASALGKLQDVVNQNAQALNTLVKQLSSNFGAISSVLN DILSRLDKVEAEVQIDRLITGRLQSLQTYVTQQLIRAAEIRASANLA ATKMSECVLGQSKRVDFCGKGYHLMSFPQSAPHGVVFLHVTYVPA QEKNFTTAPAICHDGKAHFPREGVFVSNGTHWFVTQRNFYEPQIITT DNTFVSGNCDVVIGIVNNTVYDPLQPELDSFKEELDKYFKNHTSPD VDLGDISGINASVVNIQKEIDRLNEVAKNLNESLIDLQELGKYEQYI KWPWYIWLGFIAGLIAIVMVTIMLCCMTSCCSCLKGCCSCGSCCKF DEDDSEPVLKGVKLHYT |

Figure 6

| PROTEIN | SEQ ID NO | SEQUENCE |
|---|---|---|
| Human angiotensin-converting enzyme 2 NCBI Ref No: Q9BYF1 | 820 | MSSSSWLLLSLVAVTAAQSTIEEQAKTFLDKFNHEAEDLFYQSSLA SWNYNTNITEENVQNMNNAGDKWSAFLKEQSTLAQMYPLQEIQN LTVKLQLQALQQNGSSVLSEDKSKRLNTILNTMSTIYSTGKVCNPD NPQECLLLEPGLNEIMANSLDYNERLWAWESWRSEVGKQLRPLYE EYVVLKNEMARANHYEDYGDYWRGDYEVNGVDGYDYSRGQLIE DVEHTFEEIKPLYEHLHAYVRAKLMNAYPSYISPIGCLPAHLLGDM WGRFWTNLYSLTVPFGQKPNIDVTDAMVDQAWDAQRIFKEAEKFF VSVGLPNMTQGFWENSMLTDPGNVQKAVCHPTAWDLGKGDFRIL MCTKVTMDDFLTAHHEMGHIQYDMAYAAQPFLLRNGANEGFHEA VGEIMSLSAATPKHLKSIGLLSPDFQEDNETEINFLLKQALTIVGTLP FTYMLEKWRWMVFKGEIPKDQWMKKWWEMKREIVGVVEPVPHD ETYCDPASLFHVSNDYSFIRYYTRTLYQFQFQEALCQAAKHEGPLH KCDISNSTEAGQKLFNMLRLGKSEPWTLALENVVGAKNMNVRPLL NYFEPLFTWLKDQNKNSFVGWSTDWSPYADQSIKVRISLKSALGD KAYEWNDNEMYLFRSSVAYAMRQYFLKVKNQMILFGEEDVRVAN LKPRISFNFFVTAPKNVSDIIPRTEVEKAIRMSRSRINDAFRLNDNSL EFLGIQPTLGPPNQPPVSIWLIVFGVVMGVIVVGIVILIFTGIRDRKKK NKARSGENPYASIDISKGENNPGFQNTDDVQTSF |
| Human CD147 (basigin, EMMPRIN) NCBI Ref No: Q54A51 | 821 | MAAALFVLLGFALLGTHGASGAAGTVFTTVEDLGSKILLTCSLNDS ATEVTGHRWLKGGVVLKEDALPGQKTEFKVDSDDQWGEYSCVFL PEPMGTANIQLHGPPRVKAVKSSEHINEGETAMLVCKSESVPPVTD WAWYKITDSEDKALMNGSESRFFVSSSQGRSELHIENLNMEADPG QYRCNGTSSKGSDQAIITLRVRSHLAALWPFLGIVAEVLVLVTIIFIY EKRRKPEDVLDDDDAGSAPLKSSGQHQNDKGKNVRQRNSS |

Figure 6 cont.

Gal3 peptides

| SEQ ID NO: | Peptide No. | Amino acid sequence |
|---|---|---|
| 3 | 1 | ADNFSLHDALSGSGNPNPQG |
| 4 | 2 | SGSGNPNPQGWPGAWGNQPA |
| 5 | 3 | WPGAWGNQPAGAGGYPGASY |
| 6 | 4 | GAGGYPGASYPGAYPGQAPP |
| 7 | 5 | PGAYPGQAPPGAYPGQAPPG |
| 8 | 6 | GAYPGQAPPGAYPGAPGAYP |
| 9 | 7 | AYPGAPGAYPGAPAPGVYPG |
| 10 | 8 | GAPAPGVYPGPPSGPGAYPS |
| 11 | 9 | PPSGPGAYPSSGQPSATGAY |
| 12 | 10 | SGQPSATGAYPATGPYGAPA |
| 13 | 11 | PATGPYGAPAGPLIVPYNLP |
| 14 | 12 | GPLIVPYNLPLPGGVVPRML |
| 15 | 13 | LPGGVVPRMLITILGTVKPN |
| 16 | 14 | ITILGTVKPNANRIALDFQR |
| 17 | 15 | ANRIALDFQRGNDVAFHFNP |
| 18 | 16 | GNDVAFHFNPRFNENNRRVI |
| 19 | 17 | RFNENNRRVIVCNTKLDNNW |
| 20 | 18 | VCNTKLDNNWGREERQSVFP |
| 21 | 19 | GREERQSVFPFESGKPFKIQ |
| 22 | 20 | FESGKPFKIQVLVEPDHFKV |
| 23 | 21 | VLVEPDHFKVAVNDAHLLQY |
| 24 | 22 | AVNDAHLLQYNHRVKKLNEI |
| 25 | 23 | NHRVKKLNEISKLGISGDID |
| 26 | 24 | SKLGISGDIDLTSASYTMI |

```
peptide_4  ------GAGGYPGASYPGAYPGQAPP---
peptide_5  ------PGAYPGQAPPGAYPGQAPPG-
peptide_6  ------GAYPGQAPPGAYPGAPGAYP
peptide_7  AYPGAPGAYPGAPAPGVYPG-------
                 *.***     **.***
```

Figure 7

Variable heavy chain complementarity-determining region 1 (V_H-CDR1) sequences of anti-Gal3 antibodies

|  | SEQUENCE | SEQ ID NO: |  | SEQUENCE | SEQ ID NO: |
|---|---|---|---|---|---|
| V_H_CDR1_1 | GYTFTNY | 27 | V_H_CDR1_23 | GFSLSTFGMG | 49 |
| V_H_CDR1_2 | GFSLTSY | 28 | V_H_CDR1_24 | GYTFTSYD | 50 |
| V_H_CDR1_3 | GYTFTNYW | 29 | V_H_CDR1_25 | GFTFSNYW | 51 |
| V_H_CDR1_4 | GYTFTNYG | 30 | V_H_CDR1_26 | GYTFTSYV | 52 |
| V_H_CDR1_5 | GYSFTNY | 31 | V_H_CDR1_27 | GYSFTNYI | 53 |
| V_H_CDR1_6 | GYTFTDY | 32 | V_H_CDR1_28 | GYTFRSYD | 54 |
| V_H_CDR1_7 | GYKFKTY | 33 | V_H_CDR1_29 | GFTFSNFW | 55 |
| V_H_CDR1_8 | GYTFTTY | 34 | V_H_CDR1_30 | EYAFNNYM | 56 |
| V_H_CDR1_9 | GFAFSSY | 35 | V_H_CDR1_31 | GYSFTGYT | 57 |
| V_H_CDR1_10 | GYTFTDF | 36 | V_H_CDR1_32 | GFSLINYG | 58 |
| V_H_CDR1_11 | GYAFTTY | 37 | V_H_CDR1_33 | GYTFNNYW | 59 |
| V_H_CDR1_12 | GFTFSSY | 38 | V_H_CDR1_34 | GFSLSSYG | 60 |
| V_H_CDR1_13 | GFSLTSYG | 39 | V_H_CDR1_35 | GYSFTNYW | 61 |
| V_H_CDR1_14 | GYTFTSY | 40 | V_H_CDR1_36 | GYSFTSYW | 62 |
| V_H_CDR1_15 | GYTFSDY | 41 | V_H_CDR1_37 | GYSITSGYY | 63 |
| V_H_CDR1_16 | GYTFTNFG | 42 | V_H_CDR1_38 | GFNIKDYY | 64 |
| V_H_CDR1_17 | GFTFSSYA | 43 | V_H_CDR1_39 | RYTFTDYN | 65 |
| V_H_CDR1_18 | GFSLSTSGMG | 44 | V_H_CDR1_40 | GYTFTIFG | 66 |
| V_H_CDR1_19 | GFTFSNYG | 45 | V_H_CDR1_41 | GYTFTSSW | 67 |
| V_H_CDR1_20 | GYIFTNYG | 46 | V_H_CDR1_42 | GYTFTGYW | 68 |
| V_H_CDR1_21 | GNTFTDHN | 47 | V_H_CDR1_43 | GYSFTDYN | 69 |
| V_H_CDR1_22 | GYTFTSYW | 48 | V_H_CDR1_44 | GFSLTIYG | 70 |

Figure 8

Variable heavy chain complementarity-determining region 2 (V_H-CDR2) sequences of anti-Gal3 antibodies

|  | SEQUENCE | SEQ ID NO: |  | SEQUENCE | SEQ ID NO: |
|---|---|---|---|---|---|
| V_H_CDR2_1 | NTNTGE | 71 | V_H_CDR2_22 | IYPGSSSI | 92 |
| V_H_CDR2_2 | IYPGSGNT | 72 | V_H_CDR2_23 | IYPGDGST | 93 |
| V_H_CDR2_3 | IYPGTGNT | 73 | V_H_CDR2_24 | IRLKSNNYAT | 94 |
| V_H_CDR2_4 | INTYSGVP | 74 | V_H_CDR2_25 | INTNTGES | 95 |
| V_H_CDR2_5 | ISDGGVYT | 75 | V_H_CDR2_26 | LRLKSNNYAT | 96 |
| V_H_CDR2_6 | INPKNGGI | 76 | V_H_CDR2_27 | INPYNDGT | 97 |
| V_H_CDR2_7 | VNTYSGVP | 77 | V_H_CDR2_28 | IFPGEGIS | 98 |
| V_H_CDR2_8 | IYPGSNDT | 78 | V_H_CDR2_29 | IFPGDGTT | 99 |
| V_H_CDR2_9 | ISDGGIYT | 79 | V_H_CDR2_30 | INPGSGAT | 100 |
| V_H_CDR2_10 | INTHSGVP | 80 | V_H_CDR2_31 | INPYNGGT | 101 |
| V_H_CDR2_11 | IWSGGST | 81 | V_H_CDR2_32 | FLPGDGSS | 102 |
| V_H_CDR2_12 | IDPSDSET | 82 | V_H_CDR2_33 | IWAGGST | 103 |
| V_H_CDR2_13 | IHPNSGST | 83 | V_H_CDR2_34 | INTNTGEP | 104 |
| V_H_CDR2_14 | INPNNGGT | 84 | V_H_CDR2_35 | ISYDGRN | 105 |
| V_H_CDR2_15 | IYPVSVNT | 85 | V_H_CDR2_36 | IYPEDDET | 106 |
| V_H_CDR2_16 | INTYTGEP | 86 | V_H_CDR2_37 | IYPNNGGT | 107 |
| V_H_CDR2_17 | ISSGGDT | 87 | V_H_CDR2_38 | VNTYTGEP | 108 |
| V_H_CDR2_18 | IWWDDDK | 88 | V_H_CDR2_39 | IDPYNDAT | 109 |
| V_H_CDR2_19 | ISSGGSYT | 89 | V_H_CDR2_40 | VAWDDKK | 110 |
| V_H_CDR2_20 | IYPYNGGT | 90 | V_H_CDR2_41 | ISSGDSP | 111 |
| V_H_CDR2_21 | ISSGGST | 91 | V_H_CDR2_42 | IYPGSQDT | 826 |

Figure 9

Variable heavy chain complementarity-determining region 3 (V_H-CDR3) sequences of anti-Gal3 antibodies

| | SEQUENCE | SEQ ID NO: | | SEQUENCE | SEQ ID NO: |
|---|---|---|---|---|---|
| V_H_CDR3_1 | APYDNFFAY | 112 | V_H_CDR3_31 | TRHYGFPYWYFDV | 142 |
| V_H_CDR3_2 | STAPGGFDV | 113 | V_H_CDR3_32 | QPGGVTGTLTT | 143 |
| V_H_CDR3_3 | ARFAYYYGSGGYFDY | 114 | V_H_CDR3_33 | ARYPMDY | 144 |
| V_H_CDR3_4 | ARDGNYGDPMDY | 115 | V_H_CDR3_34 | ARLLFYYAMDY | 145 |
| V_H_CDR3_5 | STPYEYDGAY | 116 | V_H_CDR3_35 | AREATAGAMDY | 146 |
| V_H_CDR3_6 | VRDGGY | 117 | V_H_CDR3_36 | AREGAGSWFAY | 147 |
| V_H_CDR3_7 | ARGPYAMDY | 118 | V_H_CDR3_37 | TYNDLGY | 148 |
| V_H_CDR3_8 | TSGYGFPY | 119 | V_H_CDR3_38 | ARKDDYYGSSPYALDY | 149 |
| V_H_CDR3_9 | ANYFGCSGWFFDV | 120 | V_H_CDR3_39 | VRDDYDSDY | 150 |
| V_H_CDR3_10 | TRDGNDGDAMDN | 121 | V_H_CDR3_40 | ARIYYYGRGYAMDY | 151 |
| V_H_CDR3_11 | AKGPYDYDLGWFAY | 122 | V_H_CDR3_41 | ARGDYYYGTRGPMDY | 152 |
| V_H_CDR3_12 | ARHGYYDY | 123 | V_H_CDR3_42 | ARWGAMDY | 153 |
| V_H_CDR3_13 | TRWGIYYYARDY | 124 | V_H_CDR3_43 | ARDRASLLRPGAMDY | 154 |
| V_H_CDR3_14 | AVPYEYDGAY | 125 | V_H_CDR3_44 | ARLDYDYDEDY | 155 |
| V_H_CDR3_15 | ATPYEYDGAY | 126 | V_H_CDR3_45 | ASPPSGYDYDVFAS | 156 |
| V_H_CDR3_16 | AYLDY | 127 | V_H_CDR3_46 | ASPPSGYDYDVFAY | 157 |
| V_H_CDR3_17 | AKSPDGYDVAWFGY | 128 | V_H_CDR3_47 | AKPPYDYDGAWFAY | 158 |
| V_H_CDR3_18 | ARWGGYAGDYYAMDF | 129 | V_H_CDR3_48 | ATGRPDY | 159 |
| V_H_CDR3_19 | ARWGGYDGDYYAMDY | 130 | V_H_CDR3_49 | AKGRPDY | 160 |
| V_H_CDR3_20 | ARWGGYAGDYYAMDY | 131 | V_H_CDR3_50 | AGYDFLWYFDV | 161 |
| V_H_CDR3_21 | ASYGNSLFDY | 132 | V_H_CDR3_51 | ARSGGYYVWFAY | 162 |
| V_H_CDR3_22 | VRYTMDY | 133 | V_H_CDR3_52 | ARSYYDGSYDAMDY | 163 |
| V_H_CDR3_23 | ARNLYDGSYGYYAMDY | 134 | V_H_CDR3_53 | ARGWFAY | 164 |
| V_H_CDR3_24 | ARHAHYYGVSPYYFDY | 135 | V_H_CDR3_54 | AKPPHDYDQAWFAY | 165 |
| V_H_CDR3_25 | AKFGNYVGAMDY | 136 | V_H_CDR3_55 | VNSNYESGY | 166 |
| V_H_CDR3_26 | ARGEYDYLAWFAY | 137 | V_H_CDR3_56 | ANSNYASGS | 167 |
| V_H_CDR3_27 | TRFTTVVEMDY | 138 | V_H_CDR3_57 | ARWGRYEYYAMDY | 168 |
| V_H_CDR3_28 | ARWGY | 139 | V_H_CDR3_58 | TMTGGPINY | 169 |
| V_H_CDR3_29 | ARIDYGDYVGFAY | 140 | V_H_CDR3_59 | ANYFGSSGWFFDV | 827 |
| V_H_CDR3_30 | AREAASNAMDY | 141 | | | |

Figure 10

Light chain complementarity-determining region 1 (V$_L$-CDR1) of anti-Gal3 antibodies

| | SEQUENCE | SEQ ID NO: | | SEQUENCE | SEQ ID NO: |
|---|---|---|---|---|---|
| V$_L$-CDR1_1 | RSSKSLLYKDGKTYLN | 170 | V$_L$-CDR1_27 | IDIDDD | 196 |
| V$_L$-CDR1_2 | KSLLHSDGITY | 171 | V$_L$-CDR1_28 | QDIVHSSGNTY | 197 |
| V$_L$-CDR1_3 | QGINSN | 172 | V$_L$-CDR1_29 | KSLLYSNGITY | 198 |
| V$_L$-CDR1_4 | QSLLYTNGKTY | 173 | V$_L$-CDR1_30 | KSVSTSGYSY | 199 |
| V$_L$-CDR1_5 | QSLFDSDGKTY | 174 | V$_L$-CDR1_31 | ESVDSYGNSF | 200 |
| V$_L$-CDR1_6 | QSIVHNNGNTY | 175 | V$_L$-CDR1_32 | QSLLYSNGKTY | 201 |
| V$_L$-CDR1_7 | QGINNY | 176 | V$_L$-CDR1_33 | QGISSN | 202 |
| V$_L$-CDR1_8 | QNIYIW | 177 | V$_L$-CDR1_34 | KSVSTSGYSC | 203 |
| V$_L$-CDR1_9 | QDISNY | 178 | V$_L$-CDR1_35 | QSLLYSDGKTY | 204 |
| V$_L$-CDR1_10 | QSIVHSNGNTY | 179 | V$_L$-CDR1_36 | ESVENHVNSF | 205 |
| V$_L$-CDR1_11 | QSLLYTDGKTY | 180 | V$_L$-CDR1_37 | SSVTY | 206 |
| V$_L$-CDR1_12 | QSVSND | 181 | V$_L$-CDR1_38 | ESLDNSGISF | 207 |
| V$_L$-CDR1_13 | QGISNY | 182 | V$_L$-CDR1_39 | QDVSTT | 208 |
| V$_L$-CDR1_14 | QDVSTA | 183 | V$_L$-CDR1_40 | QNVGIN | 209 |
| V$_L$-CDR1_15 | QNVGTN | 184 | V$_L$-CDR1_41 | QSLLDSDGKTY | 210 |
| V$_L$-CDR1_16 | QSLFHSDGKTY | 185 | V$_L$-CDR1_42 | GNIHNY | 211 |
| V$_L$-CDR1_17 | QNINIW | 186 | V$_L$-CDR1_43 | QSVSSD | 212 |
| V$_L$-CDR1_18 | QSLLHSDGKTY | 187 | V$_L$-CDR1_44 | QSLLYINGKTY | 213 |
| V$_L$-CDR1_19 | QDVRTA | 188 | V$_L$-CDR1_45 | RSLLHSNGYTY | 214 |
| V$_L$-CDR1_20 | QSVLYSSNQKNY | 189 | V$_L$-CDR1_46 | RSLLDSDGKTY | 215 |
| V$_L$-CDR1_21 | QSVLYSSSQKNY | 190 | V$_L$-CDR1_47 | QDVSSV | 216 |
| V$_L$-CDR1_22 | QSLVHNSGNTY | 191 | V$_L$-CDR1_48 | QIINNN | 217 |
| V$_L$-CDR1_23 | TGAVTTSNY | 192 | V$_L$-CDR1_49 | KSVTTSAYSY | 218 |
| V$_L$-CDR1_24 | KSLLHTNGITF | 193 | V$_L$-CDR1_50 | QSLLDRDGKTY | 219 |
| V$_L$-CDR1_25 | QSLLNSSNQKNY | 194 | V$_L$-CDR1_51 | QSVSNE | 220 |
| V$_L$-CDR1_26 | QNINVW | 195 | | | |

Figure 11

Light chain complementarity-determining region 2 (V$_L$-CDR2) of anti-Gal3 antibodies

|  | SEQUENCE | SEQ ID NO: |  | SEQUENCE | SEQ ID NO: |
|---|---|---|---|---|---|
| V$_L$-CDR2_1 | LMSTHAS | 221 | V$_L$-CDR2_15 | EGN | 235 |
| V$_L$-CDR2_2 | RMS | 222 | V$_L$-CDR2_16 | GTN | 236 |
| V$_L$-CDR2_3 | HAT | 223 | V$_L$-CDR2_17 | LAS | 237 |
| V$_L$-CDR2_4 | LLS | 224 | V$_L$-CDR2_18 | LVC | 238 |
| V$_L$-CDR2_5 | LVS | 225 | V$_L$-CDR2_19 | HGT | 239 |
| V$_L$-CDR2_6 | KVS | 226 | V$_L$-CDR2_20 | YGT | 240 |
| V$_L$-CDR2_7 | YAS | 227 | V$_L$-CDR2_21 | RAS | 241 |
| V$_L$-CDR2_8 | KAS | 228 | V$_L$-CDR2_22 | ATS | 242 |
| V$_L$-CDR2_9 | YTS | 229 | V$_L$-CDR2_23 | AAS | 243 |
| V$_L$-CDR2_10 | WAS | 230 | V$_L$-CDR2_24 | SAS | 244 |
| V$_L$-CDR2_11 | GAS | 231 | V$_L$-CDR2_25 | NVK | 245 |
| V$_L$-CDR2_12 | GIN | 232 | V$_L$-CDR2_26 | SAK | 246 |
| V$_L$-CDR2_13 | QMS | 233 | V$_L$-CDR2_27 | QAS | 247 |
| V$_L$-CDR2_14 | FAS | 234 |  |  |  |

Figure 12

Light chain complementarity-determining region 3 (V$_L$-CDR3) of anti-Gal3 antibodies

|  | SEQUENCE | SEQ ID NO: |  | SEQUENCE | SEQ ID NO: |
|---|---|---|---|---|---|
| V$_L$-CDR3_1 | QQLVDYPLT | 248 | V$_L$-CDR3_26 | QQNNEDPWT | 273 |
| V$_L$-CDR3_2 | AQMLEFPLT | 249 | V$_L$-CDR3_27 | VQGTHFPQT | 274 |
| V$_L$-CDR3_3 | VQYAQFPPT | 250 | V$_L$-CDR3_28 | VQYDQFPWT | 275 |
| V$_L$-CDR3_4 | LQSTHFPLT | 251 | V$_L$-CDR3_29 | HHSTELPYT | 276 |
| V$_L$-CDR3_5 | WQGTHFPLT | 252 | V$_L$-CDR3_30 | VQGTHLPT | 277 |
| V$_L$-CDR3_6 | FQGSHVPLT | 253 | V$_L$-CDR3_31 | QQNNEVPYT | 278 |
| V$_L$-CDR3_7 | QQYSQVPYT | 254 | V$_L$-CDR3_32 | QQWSSNPLT | 279 |
| V$_L$-CDR3_8 | LQGQSYPLT | 255 | V$_L$-CDR3_33 | QHSKEVPWT | 280 |
| V$_L$-CDR3_9 | QQYSKLPYT | 256 | V$_L$-CDR3_34 | QQHYSPPFT | 281 |
| V$_L$-CDR3_10 | AQMIEFPLT | 257 | V$_L$-CDR3_35 | QQYNSYPYT | 282 |
| V$_L$-CDR3_11 | QQDYTSPYT | 258 | V$_L$-CDR3_36 | WQGTHFPFT | 283 |
| V$_L$-CDR3_12 | QQYSELPYT | 259 | V$_L$-CDR3_37 | QHFWSIFPT | 284 |
| V$_L$-CDR3_13 | QQHYTTPLT | 260 | V$_L$-CDR3_38 | QHFWSLFPT | 285 |
| V$_L$-CDR3_14 | EQYSNFPLT | 261 | V$_L$-CDR3_39 | QHNYISPFT | 286 |
| V$_L$-CDR3_15 | QQYSSYPWT | 262 | V$_L$-CDR3_40 | QQHYNTPYT | 287 |
| V$_L$-CDR3_16 | HQYLSSLT | 263 | V$_L$-CDR3_41 | LQSTHFPQT | 288 |
| V$_L$-CDR3_17 | SQSTHVPPT | 264 | V$_L$-CDR3_42 | MQHLEYPYT | 289 |
| V$_L$-CDR3_18 | ALWYSNHWV | 265 | V$_L$-CDR3_43 | QQYSKLPRT | 290 |
| V$_L$-CDR3_19 | AQNLELPWT | 266 | V$_L$-CDR3_44 | WQGTHFPQT | 291 |
| V$_L$-CDR3_20 | QQHYSTPYT | 267 | V$_L$-CDR3_45 | QQGQSSPFT | 292 |
| V$_L$-CDR3_21 | QQGQSYPYT | 268 | V$_L$-CDR3_46 | QQTNSWPLT | 293 |
| V$_L$-CDR3_22 | LQSDNKPLT | 269 | V$_L$-CDR3_47 | QHNRELPPT | 294 |
| V$_L$-CDR3_23 | ALWYSNHLV | 270 | V$_L$-CDR3_48 | WQGTHFPT | 295 |
| V$_L$-CDR3_24 | FQGSHVPPT | 271 | V$_L$-CDR3_49 | QQHYSSPWT | 296 |
| V$_L$-CDR3_25 | QHSRELPLT | 272 |  |  |  |

Figure 13

Exemplary CDR combinations and their association with various exemplary anti-Gal3 antibodies

| Antibody name | VH CDRs | VL CDRs |
|---|---|---|
| TB001 (IMT001; IMT001-4) | SEQ ID NO: 27, 71, 112 | SEQ ID NO: 170, 221, 248 |
| TB006 (4A11.H3L1; IMT006; IMT006a) | SEQ ID NO: 31, 72, 113 | SEQ ID NO: 171, 222, 249 |
| 12G5.D7 | SEQ ID NO: 32, 73, 114 | SEQ ID NO: 172, 223, 250 |
| 13A12.2E5 | SEQ ID NO: 33, 74, 115 | SEQ ID NO: 173, 224, 251 |
| 14H10.2C9 | SEQ ID NO: 34, 74, 116 | SEQ ID NO: 174, 225, 252 |
| 15F10.2D6 | SEQ ID NO: 35, 75, 117 | SEQ ID NO: 175, 226, 253 |
| 19B5.2E6 | SEQ ID NO: 34, 74, 118 | SEQ ID NO: 176, 227, 254 |
| 20D11.2C6 | SEQ ID NO: 36, 76, 119 | SEQ ID NO: 177, 228, 255 |
| 20H5.A3 | SEQ ID NO: 37, 77, 118 | SEQ ID NO: 178, 229, 256 |
| 23H9.2E4 | SEQ ID NO: 34, 74, 118 | SEQ ID NO: 176, 227, 254 |
| 2D10.2B2 | SEQ ID NO: 32, 78, 120 | SEQ ID NO: 171, 222, 257 |
| 3B11.2G2 | SEQ ID NO: 33, 74, 115 | SEQ ID NO: 173, 225, 251 |
| 7D8.2D8 | SEQ ID NO: 38, 79, 117 | SEQ ID NO: 179, 226, 253 |
| mTB001 (mIMT001) | SEQ ID NO: 27, 71, 112 | SEQ ID NO: 170, 221, 248 |
| 4A11.2B5 | SEQ ID NO: 31, 72, 113 | SEQ ID NO: 171, 222, 249 |
| 4A11.H1L1 (IMT006b) | SEQ ID NO: 31, 72, 113 | SEQ ID NO: 171, 222, 249 |
| 4A11.H4L2 (IMT006c) | SEQ ID NO: 31, 72, 113 | SEQ ID NO: 171, 222, 249 |
| 4G2.2G6 | SEQ ID NO: 34, 80, 121 | SEQ ID NO: 180, 225, 251 |
| 6B3.2D3 | SEQ ID NO: 28, 81, 122 | SEQ ID NO: 181, 227, 258 |
| 6H6.2D6 | SEQ ID NO: 34, 74, 118 | SEQ ID NO: 182, 229, 259 |
| 9H2.2H10 | SEQ ID NO: 27, 82, 123 | SEQ ID NO: 183, 230, 260 |
| 13G4.2F8 | SEQ ID NO: 40, 83, 124 | SEQ ID NO: 184, 231, 261 |
| 13H12.2F8 | SEQ ID NO: 34, 74, 125 | SEQ ID NO: 185, 225, 252 |
| 15G7.2A7 | SEQ ID NO: 32, 84, 119 | SEQ ID NO: 186, 228, 255 |
| 19D9.2E5 | SEQ ID NO: 34, 74, 126 | SEQ ID NO: 187, 225, 252 |
| 23B10.2B12 | SEQ ID NO: 41, 85, 127 | SEQ ID NO: 171, 222, 249 |
| 24D12.2H9 | SEQ ID NO: 28, 81, 128 | SEQ ID NO: 188, 230, 262 |
| F846C.1B2 | SEQ ID NO: 30, 86, 129 | SEQ ID NO: 189, 230, 263 |
| F846C.1F5 | SEQ ID NO: 30, 86, 130 | SEQ ID NO: 189, 230, 263 |
| F846C.1H12 | SEQ ID NO: 42, 86, 131 | SEQ ID NO: 190, 230, 263 |

Figure 14

| Antibody name | VH CDRs | VL CDRs |
|---|---|---|
| F846C.1H5 | SEQ ID NO: 43, 87, 132 | SEQ ID NO: 191, 226, 264 |
| F846C.2H3 | SEQ ID NO: 30, 86, 130 | SEQ ID NO: 189, 230, 263 |
| F846TC.14A2 | SEQ ID NO: 30, 86, 133 | SEQ ID NO: 192, 232, 265 |
| F846TC.14E4 | SEQ ID NO: 44, 88, 134 | SEQ ID NO: 193, 233, 266 |
| F846TC.16B5 | SEQ ID NO: 30, 86, 130 | SEQ ID NO: 189, 230, 263 |
| F846TC.7F10 | SEQ ID NO: 45, 89, 135 | SEQ ID NO: 194, 234, 267 |
| F847C.10B9 | SEQ ID NO: 46, 86, 136 | SEQ ID NO: 195, 228, 268 |
| F847C.11B1 | SEQ ID NO: 47, 90, 137 | SEQ ID NO: 196, 235, 269 |
| F847C.12F12 | SEQ ID NO: 30, 86, 136 | SEQ ID NO: 195, 228, 268 |
| F847C.26F5 | SEQ ID NO: 46, 86, 136 | SEQ ID NO: 195, 228, 268 |
| F847C.4B10 | SEQ ID NO: 43, 91, 138 | SEQ ID NO: 192, 236, 270 |
| F849C.8D10 | SEQ ID NO: 48, 92, 139 | SEQ ID NO: 197, 226, 271 |
| F849C.8H3 | SEQ ID NO: 49, 88, 140 | SEQ ID NO: 198, 233, 266 |
| 846.2B11 | SEQ ID NO: 50, 93, 141 | SEQ ID NO: 199, 237, 272 |
| 846.4D5 | SEQ ID NO: 51, 94, 142 | SEQ ID NO: 200, 237, 273 |
| 846T.1H2 | SEQ ID NO: 30, 95, 143 | SEQ ID NO: 201, 238, 274 |
| 847.14H4 | SEQ ID NO: 32, 86, 144 | SEQ ID NO: 192, 236, 270 |
| 846.2D4 | SEQ ID NO: 51, 96, 142 | SEQ ID NO: 200, 237, 273 |
| 846.2F11 | SEQ ID NO: 52, 97, 145 | SEQ ID NO: 172, 239, 275 |
| 846T.10B1 | SEQ ID NO: 50, 93, 141 | SEQ ID NO: 199, 237, 272 |
| 846T.2E3 | SEQ ID NO: 50, 93, 141 | SEQ ID NO: 199, 237, 272 |
| 846T.4C9 | SEQ ID NO: 53, 97, 145 | SEQ ID NO: 202, 240, 275 |
| 846T.4E11 | SEQ ID NO: 54, 98, 146 | SEQ ID NO: 203, 237, 276 |
| 846T.4F5 | SEQ ID NO: 55, 94, 142 | SEQ ID NO: 200, 237, 273 |
| 846T.8D1 | SEQ ID NO: 50, 99, 147 | SEQ ID NO: 199, 237, 272 |
| 847.10C9 | SEQ ID NO: 56, 100, 148 | SEQ ID NO: 204, 225, 277 |
| 847.11D6 | SEQ ID NO: 57, 101, 149 | SEQ ID NO: 205, 241, 278 |
| 847.15D12 | SEQ ID NO: 29, 102, 150 | SEQ ID NO: 192, 236, 270 |
| 847.15F9 | SEQ ID NO: 58, 81, 151 | SEQ ID NO: 206, 242, 279 |
| 847.15H11 | SEQ ID NO: 59, 82, 152 | SEQ ID NO: 207, 243, 280 |

Figure 14 cont.

| Antibody name | VH CDRs | VL CDRs |
|---|---|---|
| 847.20H7 | SEQ ID NO: 29, 82, 153 | SEQ ID NO: 208, 230, 281 |
| 847.21B11 | SEQ ID NO: 39, 103, 154 | SEQ ID NO: 209, 244, 282 |
| 847.27B9 | SEQ ID NO: 30, 104, 155 | SEQ ID NO: 210, 225, 283 |
| 847.28D1 | SEQ ID NO: 39, 103, 156 | SEQ ID NO: 211, 245, 284 |
| 847.2B8 | SEQ ID NO: 58, 81, 151 | SEQ ID NO: 206, 242, 279 |
| 847.3B3 | SEQ ID NO: 39, 103, 157 | SEQ ID NO: 211, 246, 285 |
| 849.1D2 | SEQ ID NO: 60, 103, 158 | SEQ ID NO: 212, 234, 286 |
| 849.2D7 | SEQ ID NO: 61, 82, 159 | SEQ ID NO: 183, 230, 267 |
| 849.2F12 | SEQ ID NO: 62, 82, 160 | SEQ ID NO: 183, 230, 287 |
| 849.4B2 | SEQ ID NO: 63, 105, 161 | SEQ ID NO: 213, 225, 288 |
| 849.4F12 | SEQ ID NO: 49, 88, 140 | SEQ ID NO: 172, 239, 275 |
| 849.4F2 | SEQ ID NO: 63, 105, 161 | SEQ ID NO: 213, 225, 288 |
| 849.5C2 | SEQ ID NO: 64, 106, 162 | SEQ ID NO: 214, 222, 289 |
| 849.8D12 | SEQ ID NO: 65, 107, 163 | SEQ ID NO: 182, 229, 290 |
| F847C.21H6 | SEQ ID NO: 66, 108, 164 | SEQ ID NO: 215, 225, 291 |
| 849.5H1 | SEQ ID NO: 39, 103, 165 | SEQ ID NO: 195, 247, 292 |
| 847.23F11 | SEQ ID NO: 67, 82, 166 | SEQ ID NO: 216, 230, 267 |
| 847.16D10 | SEQ ID NO: 68, 82, 167 | SEQ ID NO: 192, 236, 270 |
| 847.13E2-mH0mL1 | SEQ ID NO: 69, 109, 168 | SEQ ID NO: 217, 229, 293 |
| 847.13E2-mH0mL2 | SEQ ID NO: 69, 109, 168 | SEQ ID NO: 218, 237, 294 |
| 847.12C4 | SEQ ID NO: 70, 110, 169 | SEQ ID NO: 219, 225, 295 |
| 847.4D3 | SEQ ID NO: 43, 111, 138 | SEQ ID NO: 220, 227, 296 |
| 2D10-VH0-VL0 | SEQ ID NO: 32, 826, 827 | SEQ ID NO: 171, 222, 257 |

Figure 14 cont.

Heavy chain variable region (V$_H$) sequences of anti-Gal3 antibodies

| | SEQUENCE | SEQ ID NO: |
|---|---|---|
| V$_H$-1 | QVQLVQSGSELKKPGASVKVSCKASGYTFTNYGMNWVRQAPGQGLKWMGW INTNTGEPTYVEEFTGRFVFSLETSVSTAYLQISSLKAEDTAVYFCAPYDNFFAY WGQGTTVTVSS | 297 |
| V$_H$-2 | QVQLVQSGAEVKKPGASVKVSCKASGYSFTNYYMHWVRQAPGQRLEWMG WIYPGSGNTNYNEKFQGRVTITADTSASTAYMELSSLRSEDTAVYYCSTAPGG FDVWGQGTTVTVSS | 298 |
| V$_H$-3 | QVQLKQSGAELVRPGASVKLSCKASGYTFTDYYINWVKQRPGQGLEWIARIY PGTGNTDYNEKFKGRATLTAEKSSSTAYMQLSSLTSEDSAVYFCARFAYYYGS GGYFDYWGHGTTLTVSS | 299 |
| V$_H$-4 | QIQLVQSGPELKKPGETVKISCKTSGYKFKTYVMSWVKQAPGKALKWMGWI NTYSGVPTYADDFKGRFAFSLETSASTAYLEIINLKNEDTATYFCARDGNYGD PMDYWGQGTSVTVSS | 300 |
| V$_H$-5 | QIQLVQSGPELKKPGETVKISCKASGYTFTTYGMWVKQAPGKDLKWMGWI NTYSGVPTYADDFKGRFAFSLETSASTAYLQISNLKNEDTATYFCSTPYEYDG AYWGQGTLVTVSA | 301 |
| V$_H$-6 | EVQLVESGGGLVKPGGSLKLSCAASGFAFSSYAMSWVRQTPEKRLEWVATIS DGGVYTYYTDHVKGRFTISRDNAEDNLYLQMSHLKSEDTAMYYCVRDGGY WGQGTTLTVSS | 302 |
| V$_H$-7 | QIQLVQSGPELKKPGETVKISCKASGYTFTTYAMSWVKQAPGKGLKWMGWIN TYSGVPTYADDLKGRFAFSLETSASTAYLQINNLKNEDTATYFCARGPYAMD YWGQGTSVTVSS | 303 |
| V$_H$-8 | EVQLQQSGPELVKPGASVKISCKASGYTFTDFYINWVKQSHGKSLEWIGDINP KNGGINYNPKFKIKATLTVDKSSSTSYMDLRGLTSEDSAVYYCTSGYGFPYWG QGTLVTVSA | 304 |
| V$_H$-9 | QIQLVQSGPELKKPGESVKISCKASGYAFTTYGMSWVQQAPGKGLKWMGWV NTYSGVPTCADDFKGRFAFSLETSASTAYLQINNLRNEDTATYFCARGPYAMD YWGQGTSVTVSS | 305 |
| V$_H$-10 | QVQLQQSGPELVKPGASVKISCKASGYTFTDYYINWVKQRPGQGLEWIGWIYP GSNDTKYNEKFKGKATLTVDTSSSTAYMQLGSLTSEDSAVYFCANYFGCSGW FFDVWGTGTTVTVSS | 306 |
| V$_H$-11 | EVQLVESGGGLVKPGGSLKLSCAASGFTFSSYAMSWVRQTPEKRLEWVATISD GGIYTYYPDNVKGRFTISRDNAKNNLFLQMSHLKSEDTAMYYCVRDGGYWG QGTTLTVSS | 307 |
| V$_H$-12 | QIQLVQSGPELKKPGETVKISCKASGYTFTNYGMNWVKQAPGKGLKWMGWI NTNTGEPTYVEEFKGRFAFSLETSASTAYLQINNLKNEDTATYFCAPYDNFFAY WGQGTLVTVSA | 308 |
| V$_H$-13 | QVQLQQSGPELVKPGASVKISCKASGYSFTNYYIHWVKQRPGQGLEWIGWIYP GSGNTNYNEKFKGKATLTADTSSSTTNMQLSSLTSEDSAVYYCSTAPGGFDV WGSGTTVTVSS | 309 |
| V$_H$-14 | QVQLVQSGAEVKKPGASVKVSCKASGYSFTNYYMHWVRQAPGQGLEWMG WIYPGSGNTNYNEKFQGRVTMTADTSISTAYMELSRLRSDDTAVYYCSTAPG GFDVWGQGTTVTVSS | 310 |

Figure 15

| | SEQUENCE | SEQ ID NO: |
|---|---|---|
| V<sub>H</sub>-15 | QVQLVQSGAEVKKPGASVKVSCKASGYSFTNYYIHWVRQAPGQRLEWMGWI YPGSGNTNYNEKFQGRVTLTADTSASTTYMELSSLRSEDTAVYYCSTAPGGFD VWGQGTTVTVSS | 311 |
| V<sub>H</sub>-16 | QIQLVQSGPDLKKPGETVKISCKASGYTFTTYVMSWVKQAPGKDLKWMGWI NTHSGVPTYADDFKGRFDFSLETSANTAFLQINNLKNEDTATYFCTRDGNDGD AMDNWGQGTSVTVSS | 312 |
| V<sub>H</sub>-17 | QVQLKQSGPGLVQPSQSLSITCTVSGFSLTSYGVHWVRQPPGKGLEWLGVIWS GGSTDYNAAFISRLSISKDNSKSQVFFKMNSLQADDTAIYYCAKGPYDYDLGW FAYWGQGTLVTVSA | 313 |
| V<sub>H</sub>-18 | QIQLVQSGPELKKPGETVKISCKASGYTFTTYGMSWVKQAPGKGLKWMAWIN TYSGVPTYADDFKGRFAFSLETSASTAYLQINNLTNEDTATYFCARGPYAMDY WGQGTSVTVSS | 314 |
| V<sub>H</sub>-19 | QVQLQQPGAELVGPGSSVKLSCKASGYTFTNYWIHWVKQRPLQGLEWIGNID PSDSETHYNQKFKDKATLTVDKSSSTAYMQLSSLTSEDSAVYYCARHGYYDY WGQGTTLTVSS | 315 |
| V<sub>H</sub>-20 | QVQLQQPGAELVKPGASVKLSCKASGYTFTSYWMHWVKQRPGQGLEWIGMI HPNSGSTDYNEKFKNKATLNVDKSSSTAYIQLSSLTSEDSAVYYCTRWGIYYY ARDYWGQGTTLTVSS | 316 |
| V<sub>H</sub>-21 | QIQLVQSGPELKKPGETVKISCKASGYTFTTYGMSWVKQAPGKGLKWMGWIN TYSGVPTYADDFKGRFAFSLETSASTAYLQINNLKNEDTATYFCAVPYEYDGA YWGQGTLVTVSA | 317 |
| V<sub>H</sub>-22 | EVQLQQSGPELVKPGASVKISCKASGYTFTDYYMNWVKQSHGKSLEWIGDIN PNNGGTNYNQKFKGKATLTVDKSSSTAYMELRSLTSEDSAVYYCTSGYGFPY WGQGTLVTVSA | 318 |
| V<sub>H</sub>-23 | QIQLVQSGPELKKPGETVKISCKASGYTFTTYGMGWVKQAPGKGLKWMGWI NTYSGVPTYADDFKGRFAFSLETSTSTAYLQINNLKNEDMATYFCATPYEYDG AYWGQGTLVTVSA | 319 |
| V<sub>H</sub>-24 | QVQLQQSGPELVKPGDSVKISCKAAGYTFSDYYINWVKQRPGQGLEWIGWIY PVSVNTKYNEKFKGKATLTVDTSSSTAYMQLSSLTSEDSGVYFCAYLDYWGQ GTLVTVSA | 320 |
| V<sub>H</sub>-25 | QVQLKQSGPGLVQPSQSLSITCTVSGFSLTSYGVHWVRQAPGKGLEWLGVIWS GGSTDYNAAFMSRLSISKDNSKSQVFFKMNSLQADDTAIYYCAKSPDGYDVA WFGYWGQGTLVTVSA | 321 |
| V<sub>H</sub>-26 | QIQLVQSGPELKKPGETVKISCKASGYTFTNYGMNWVKQAPGKGLKWMGWI NTYTGEPSYADDFKGRFAFSLETSASTAYLQINNLKNEDMATYFCARWGGYA GDYYAMDFWGQGTSVTVSS | 322 |
| V<sub>H</sub>-27 | QIQLVQSGPELKKPGETVKISCKASGYTFTNYGMNWVKQAPGKGLKWMGWI NTYTGEPSYADDFKGRFAFSLETSASTAYLQINNLKNEDMATYFCARWGGYD GDYYAMDYWGQGTSVTVSS | 323 |
| V<sub>H</sub>-28 | QIQLVQSGPELKKPGETVKISCKASGYTFTNFGMNWVKQAPGKGLKWMGWI NTYTGEPSYADDFKGRFAFSLETSASTAYLQINNLKNEDIATYFCARWGGYAG DYYAMDYWGQGTSVTVSS | 324 |
| V<sub>H</sub>-29 | EVQLLESGGGLVKPGGSLKLSCAASGFTFSSYAMSWVRQTPEKRLEWVASISS GGDTYYPDSVKGRFTISRDNARNILYLQMSSLRSEDTAMYYCASYGNSLFDY WGQGTTLTVSS | 325 |

Figure 15 cont.

| | SEQUENCE | SEQ ID NO: |
|---|---|---|
| V$_H$-30 | QIQLVQSGPELKKPGETVKISCKASGYTFTNYGMNWVKQAPGKGLKWMGWI NTYTGEPTYAGDLKGRFAFSLETSASTAYLQINNLKNEDTATYFCVRYTMDY WGQGTSVTVSS | 326 |
| V$_H$-31 | QVTLKESGPGILQPSQTLSLTCSFSGFSLSTSGMGVGWIRQPSGKGLEWLAHIW WDDDKYYNTALKSGLTISKDASKNQVFLKIASMDTADTATYYCARNLYDGS YGYYAMDYWGQGTSVTVSS | 327 |
| V$_H$-32 | QIQLVQSGPELKKPGETVKISCKASGYTFTNYGMNWVKQAPGKGLKWMGWI NTYTGEPAYADDFKGRFAFSLETSASTAYLQINNLKNEDMATYFCARWGGYD GDYYAMDYWGQGTSVTVSS | 328 |
| V$_H$-33 | EVQLVESGGDLVKPGGSLKLSCAASGFTFSNYGLSWIRQTPDKRLEWVATISS GGSYTYYPDSVKGRFTISRDSAKNTLYLQMSSLKSEDTAMYYCARHAHYYGV SPYYFDYWGQGTCLTVSS | 329 |
| V$_H$-34 | QIQLVQSGPEVKKPGETVKISCKASGYIFTNYGMNWVKQAPGKGLKWMGWI NTYTGEPTYTDDFKGRFAFSLETSASTAYLQINNLKNEDTATYFCAKFGNYVG AMDYWGQGTSVTVSS | 330 |
| V$_H$-35 | EVQLQQSGPELVKPGASVKISCKASGNTFTDHNMHWVKQSHGKSLEWIGYIY PYNGGTGYNQKFKSKATLTVDNSSSTVYMELRSLTSEDSAVYYCARGEYDYL AWFAYWGQGTLVTVSA | 331 |
| V$_H$-36 | QIQLVQSGPELKKPGETVKISCKASGYTFTNYGMNWVKQAPGKGLKWMGWI NTYTGEPTYVDDFKGRFAFSLETSASTAYLRINNLKNEDTATYFCAKFGNYVG AMDYWGQGTSVTVSS | 332 |
| V$_H$-37 | EVQLVETGGGLVKPGGSLKLSCAASGFTFSSYAMSWVRQTPEKRLEWVASISS GGSTYYPDSVKGRFTISRDNARNILYLQMSSLRSEDTAMYYCTRFTTVVEMDY WGQGTSVTVSS | 333 |
| V$_H$-38 | QVQLQQTGAELVKPGASVKLSCKASGYTFTSYWINWVKQRPGQGLEWIGNIY PGSSSIYYSEKFKSKATLTVDTSSSTAYMQLSSLTSDDSAVYYCARWGYWGQ GTTLTVSS | 334 |
| V$_H$-39 | QVTLKESGPGILQPSQTLSLTCSFSGFSLSTFGMGVGWIRQPSGKGLEWLAHIW WDDDKHYNPALKSRLTISKDTSKNQVFLRIANVDTADNATYYCARIDYGDYV GFAYWGQGTLVTVSA | 335 |
| V$_H$-40 | QVQLQQSGPELVRPGALVKISCKASGYTFTSYDINWVKQRPGQGLEWIGWIYP GDGSTKYNEKFKGKATLTADKSSSTAYMQLSSLTSENSAVYFCAREAASNAM DYWGQGTSVTVSS | 336 |
| V$_H$-41 | EVKLEESGGGLVQPGGSMKLSCVASGFTFSNYWMNWVRQSPEKGLEWVAEI RLKSNNYATHYAESVKGRFTISRDDSKSSVYLQMNNLRAEDTGIYYCTRHYGF PYWYFDVWGAGTTVTVSS | 337 |
| V$_H$-42 | QIQLVQSGPELKKPGETVKISCKASGYTFTNYGMNWVKQAPGKGLKWMGWI NTNTGEPTYAEEFKGRFAFSLETSASTAYLQINNLKNEDTATYFCATGGGNWD FDYWGQGTTLTVSS | 338 |
| V$_H$-43 | QIQLVQSGPELTKPGETVKISCKASGYTFTDYGMNWVRQAPGETLKWMGWIN TYTGEPTYADDFKGRFAFSLESSASTAYLQINNLKNEDVATYFCARYPMDYW GQGTSVTVSS | 339 |

Figure 15 cont.

| | SEQUENCE | SEQ ID NO: |
|---|---|---|
| V_H-44 | EVKLEESGGGLVQPGGSMKLSCVASGFTFSNYWMNWVRQSPEKGLEWVAEL RLKSNNYATHYAESVKGRFTISRDDSKSSVYLQMNNLRAEDTGIYYCTRHYGF PYWYFDVWGAGTTVTVSS | 340 |
| V_H-45 | EVQLQQSGPELVKPGASVKMSCKASGYTFTSYVMHWVKQKPGQGLEWIGYI NPYNDGTKYNEKFKGKATLTSDKSSSTAYMELSSLTSEDSAVYYCARLLFYY AMDYWGQGTSVTVSS | 341 |
| V_H-46 | QVQLQQSGPELVRPGALVKISCKASGYTFTSYDINWVKQRPGQGLEWIGWIYP GDGSTKYNEKFKGKATLTADKSSSTVYMQLSSLTSENSAVYFCAREAASNAM DYWGQGTSVTVSS | 342 |
| V_H-47 | QVQLQQSGPELVKPGALVKISCKASGYTFTSYDINWVKQRPGQGLEWIGWIYP GDGSTKYNEKFKGKAALTADKSSSTAYMQLSSLTSENSAVYFCAREAASNAM DYWGQGTSVTVSS | 343 |
| V_H-48 | EVQLQQSGPELVKPGASVKMSCKASGYSFTNYIMHWVKQKPGQGLEWIGYIN PYNDGTKYNEKFKGKATLTSDKSSSTAYMELSSLTSEDSAVYYCARLLFYYA MDYWGQGTSVTVSS | 344 |
| V_H-49 | QVQLQQSGAELVKPGASVKLSCKASGYTFRSYDINWVRQRPEQGLEWIGWIFP GEGISKYNEKFKGKATLTTDKLSSTAYMQLSSLTSEDSAVYFCAREATAGAM DYWGQGTSVTVSS | 345 |
| V_H-50 | EVKLLESGGGLVQPGGSMKLSCVASGFTFSNFWMNWVRQSPEKGLEWVAEIR LKSNNYATHYAESVKGRFTISRDDSKSSVYLQMNNLRAEDTGIYYCTRHYGFP YWYFDVWGAGTTVTVSS | 346 |
| V_H-51 | QIQLQQSGAELVKPGASVKLSCKASGYTFTSYDICWVRQRPEQGLEWIGWIFP GDGTTKYTENFKGKATLTTDKSSSTAYMHLSRLTSEDSAVYFCAREGAGSWF AYWGQGTLVTVSA | 347 |
| V_H-52 | EVQLQQSGAELVRPGTSVKVSCKASEYAFNNYMMEWVKQRPGQGLEWIGVI NPGSGATNYNENFKDKATLTADKSSTTAYMQLSSLTSDDSAVYFCTYNDLGY WGQGTLVTVSA | 348 |
| V_H-53 | EVKLQQSGPELMKPGTSMKISCKASGYSFTGYTMNWVKQSHGKNLEWIGLIN PYNGGTNYNQKFRGKATLSVDKSSNTAYMELLSLTSEDSAVYYCARKDDYY GSSPYALDYWGQGTSVTVSS | 349 |
| V_H-54 | QVQLQQSGAELMKPGASVKISCKATGYTFTNYWIEWVKQRPGHGLEWIGEFL PGDGSSHYNEKFKGKATFTSDTSSNTAYIHLTSLTSEDSAVYYCVRDDYDSDY WAQGTTLTVSS | 350 |
| V_H-55 | QVQMKQSGPGLVQPSQSLSITCTVSGFSLINYGVHWVRQSPGKGLEWLGVIWS GGSTDYNAAFISRLSISKDNSKSQVFFKMNSLQADDTAIYYCARIYYYGRGYA MDYWGQGTSVTVSS | 351 |
| V_H-56 | EVQLQQSGAEVVKPGAPVKLSCKASGYTFNNYWLNWVKQRPGRGLEWIGRI DPSDSETHYNQKFKDKATLTVDMSSSTAYIQLSSLTSEDSAVYYCARGDYYYG TRGPMDYWGQGTSVTVSS | 352 |
| V_H-57 | QVQLQQSGAELVRPGASVNLSCKASGYTFNYWMNWVKQRPGQGLEWVGM IDPSDSETHYNQMFKDKATLTIDKSSSIAYMQLSSLTSEDSAVYYCARWGAMD YWGQGTSVTVSS | 353 |

Figure 15 cont.

| | SEQUENCE | SEQ ID NO: |
|---|---|---|
| V_H-58 | QVQLKQSGPGLVAPSQSLSITCTVSGFSLTSYGVHWVRQPPGKGLEWLGIIWA GGSTNYNPALMSRLSISKDKSKSQVFLKMNSLKTDDTAMYYCARDRASLLRP GAMDYWGQGTSVTVSS | 354 |
| V_H-59 | QIQLVQSGPELKKPGETVKISCKASGYTFTNYGMNWVKQAPGKGLKWMGWI NTNTGEPTYAEEFKGRFAFSLETSASTAYLQINYLKNEDTATFFCARLDYDYD EDYWGQGTTLTVSS | 355 |
| V_H-60 | QVQLVETGPGLVAPSQSLSITCTVSGFSLTSYGVHWIRQSPGKGLEWLGTIWA GGSTDYNSPLMSRLSISKDNSKNQVFLKMNSLQIDDTAIYYCASPPSGYDYDV FASWGQGTLVTVSA | 356 |
| V_H-61 | QVQLKQSGPGLVQPSQSLSITCTVSGFSLINYGVHWVRQSPGKGLEWLGVIWS GGSTDYNAAFISRLSISKDNSKSQVFFKMNSLQADDTAIYYCARIYYYGRGYA MDYWGQGTSVTVSS | 357 |
| V_H-62 | QVQLKESGPGLVAPSQSLSITCTVSGFSLTSYGVHWIRQPPGKGLEWLGGIWA GGSTDYNSPLMSRLSITKDNSKSQVFLKMNSLQSDDTAMYYCASPPSGYDYD VFAYWGQGTLVTVSA | 358 |
| V_H-63 | QVQLKESGPVLVAPSQSLSITCTVSGFSLSSYGVHWVRQPPGKGLEWLGVIWA GGSTDYDSALMSRLSISKDNSKSQVFLKMDSLQTDDTAMYYCAKPPYDYDGA WFAYWGQGTLVTVSA | 359 |
| V_H-64 | QVQLQQSGPQLVRPGASVKISCKASGYSFTNYWMHWVKQRPGQGLEWIGMI DPSDSETRLNQKFKDKATLTVDKSSSTAYMQLSSPTSEDSAVYYCATGRPDY WGQGTTLTVSS | 360 |
| V_H-65 | QVQLQQSGPQLVRPGASVKISCKASGYSFTSYWMHWVKQRPGQGLEWIGMID PSDSETRLNQKFKDKATLTVDKSSSTAYMQLSSPTSEDSIVYYCAKGRPDYWG QGTTLTVSS | 361 |
| V_H-66 | DGKLQESGPGLVKPSQSLSLTCSVTGYSITSGYYWNWIRQFPGNKLEWMGHIS YDGRNNYNPSLKNRISITRDTSKNQFFLKLNSVTTEDTATYYCAGYDFLWYFD VWGTGTTVTVSS | 362 |
| V_H-67 | QVQLKESGPGILQPSQTLSLTCSFSGFSLSTFGMGVGWIRQPSGKGLEWLAHIW WDDDKHYNPALKSRLTISKDTSKNQVFLRIANVDTADNATYYCARIDYGDYV GFAYWGQGTLVTVSA | 363 |
| V_H-68 | DGQLQESGPGLVKPSQSLSLTCSVTGYSITSGYYWNWIRQFPGNKLEWMGHIS YDGRNNYNPSLKNRISITRDTSKNQFFLKLNSVTTEDTATYYCAGYDFLWYFD VWGTGTTVTVSS | 364 |
| V_H-69 | EVQLQQSGAELVKSGASVKLSCTASGFNIKDYYMHWVKQRTEQGLEWIGRIY PEDDETKYAPKFQGKATITADTSSNTAYLQLSSLTSEDTAVYYCARSGGYYV WFAYWGQGTLVTVSA | 365 |
| V_H-70 | EVQLQQSGPELVKPGSSVKISCKASRYTFTDYNMDWVKQSHGKRLEWIGYIYP NNGGTGYNQKFKGKATLTVDKSSSTAYMELRSLTSEDSAVYYCARSYYDGSY DAMDYWGQGTSVTVSS | 366 |
| V_H-71 | QIQLVQSGPELKKPGETVKISCKASGYTFTIFGMNWVKQAPGKGLKWMGWV NTYTGEPTYADDFKGRFAFSLETSASTAYLQINNLKNEDTATYFCARGWFAY WGQGTLVTVSA | 367 |

Figure 15 cont.

| | SEQUENCE | SEQ ID NO: |
|---|---|---|
| V$_H$-72 | QVQLKESGPVLVAPSQSLSITCTVSGFSLTSYGIHWVRQPPGKGLEWLGVIWA GGSTNYNSALMSRLSISKDNSKSQVFLKMNSLQIDDTAMYYCAKPPHDYDQA WFAYWGQGTLITVSA | 368 |
| V$_H$-73 | QVQLQQSGAELVRPGASVKLSCKASGYTFTSSWMNWVKQRPGQGLDWIGMI DPSDSETHYNQMFKDKATLTVDKSSNTAYMQLSRLTSEDSAVYYCVNSNYES GYWGQGTTLTVSS | 369 |
| V$_H$-74 | QVQLQQSGAELVRPGASVKLSCKASGYTFTGYWLNWVKQRPGQGLEWIGMI DPSDSETHYNQVFKDKATMTVDRSSSTAYMQLSGLTSEDSAVYYCANSNYAS GSWGQGTTLTVSS | 370 |
| V$_H$-75 | EVQLQQSGPELVKPGASVKVSCKASGYSFTDYNMYWVMQSHGKSLEWIGYI DPYNDATSYSQKFTGKATLTVDKSSSTAFMHLNSLTSEDSAVYYCARWGRYE YYAMDYWGQGTSVTVSS | 371 |
| V$_H$-76 | QVQLKESGPDLVQPSQTLSLTCTVSGFSLTIYGVHWVRQPPGKGLEWVGTVA WDDKKYYNSPLQSRLSISRDTSKNQVFLKLSSLQTEDTAMYYCTMTGGPINY WGPGTSVTVSS | 372 |
| V$_H$-77 | EVQLVESGGGLVKPGGSLKLSCAASGFTFSSYAMSWVRQTPEKRLEWVASISS GDSPYYPDSVKGRFTISRDNARNILYLQMSSLRSEDTAMYYCTRFTTVVEMDY WGQGTSVTVSS | 373 |
| V$_H$-78 | QVQLKQSGPELVKPGDSVKISCKAAGYTFSDYYINWVKQRPGQGLEWIGWIY PVSVNTKYNEKFKGKATLTVDTSSSTAYMQLSSLTSEDSGVYFCAYLDYWGQ GTLVTVSA | 822 |
| V$_H$-79 | QVQLQQSGPELVKPGASVKISCKASGYTFTDYYINWVKQRPGQGLEWIGWIYP GSQDTKYNEKFKGKATLTVDTSSSTAYMQLGSLTSEDSAVYFCANYFGSSGW FFDVWGTGTTVTVSS | 828 |

Figure 15 cont.

Light chain variable region (V_L) sequences of anti-Gal3 antibodies

| | SEQUENCE | SEQ ID NO: |
|---|---|---|
| V_L-1 | DIVLTQSPLSLPVTPGEPASISCRSSKSLLYKDGKTYLNWFLQKPGQSPQLLIYLMSTHASGVPDRFSGSGSGTDFTLKISRVEAEDVGVYYCQQLVDYPLTFGGGTKLEIK | 374 |
| V_L-2 | DIVMTQTPLSLSVTPGQPASISCKSSKSLLHSDGITYLYWYLQKPGQSPQLLIYRMSNLASGVPDRFSGSGSGTDFTLKISRVEAEDVGVYYCAQMLEFPLTFGQGTKLEIK | 375 |
| V_L-3 | DILMTQSPSSMSVSLGDTVSITCHASQGINSNMGWLQQKPGKSFKGLIYHATNLEDGVPSRFSGSGSGADYSLTISSLESEDFADYYCVQYAQFPPTFGSGTKLEIK | 376 |
| V_L-4 | DVVMTQTPLTLSVAIGQPASISCKSSQSLLYTNGKTYLNWLLQRPGQSPKRLIYLLSKLDSGVPDRFSASGSGTDFTLKISRVEAEDLGVYYCLQSTHFPLTFGAGTKLEMK | 377 |
| V_L-5 | DVVMTQTPLTLSVTIGQPASISCKSSQSLFDSDGKTYLNWLLQRPGQSPKRLIYLVSKLDSGVPDRFTGSGSGTDFTLKISRVEAEDLGVYYCWQGTHFPLTFGAGTKLEMK | 378 |
| V_L-6 | DVLMTQTPLSLPVSLGDQASISCRSSQSIVHNNGNTYLEWYLQKPGQSPKLLIYKVSNRFSGVPDRFSGSGSGTDFTLKISRVEAEDLGVYYCFQGSHVPLTFGGGTKLELK | 379 |
| V_L-7 | DIQMTQTTSSLSASLGDRVTISCSASQGINNYLNWYQQKPDGTVKLLIYYASSLHSGVPSRFSGSGSGTDYSLTISNLEPEDIATYYCQQYSQVPYTFGSGTKLEIK | 380 |
| V_L-8 | DIQMNQSPSSLSASLGDTITITCRASQNIYIWLSWYQQKPGNIPKLLIYKASNLHTGVPSRFSGSGSGTDFTLTISTLQPEDIATYFCLQGQSYPLTFGAGTKLEMK | 381 |
| V_L-9 | DIQMTQTTSSLSASLGDRVTINCSASQDISNYLNWYQQKPDGTVKLLIYYTSSLLSGVPSRFSGSGSGTDYSLTISNLEPEDIATYFCQQYSKLPYTFGSGTHLEIK | 382 |
| V_L-10 | DIVMTQAAFSNPVTLGTSASISCRSSKSLLHSDGITYLYWYLQRPGQSPQLLIYRMSNLASGVPDRFSGSGSGTDFTLRISRVEAEDVGVYYCAQMIEFPLTFGAGTILELK | 383 |
| V_L-11 | DVVMTQTPLTLSVAIGQPASISCKSSQSLLYTNGKTYLNWLLQRPGQSPKRLIYLVSKLDSGVPDRFSGSGSGTDFTLKISRVEAEDLGVYYCLQSTHFPLTFGAGTKLELK | 384 |
| V_L-12 | DVLMTQTPLSLPVSLGDQASISCRSSQSIVHSNGNTYLEWYLQKPGQSPKLLIYKVSNRFSGVPDRFSGSGSGTDFTLKISRVEAEDLGVYYCFQGSHVPLTFGAGTKLELK | 385 |
| V_L-13 | DIVITQDELSNPVTSGESVSISCRSSKSLLYKDGKTYLNWFLQRPGQSPQLLIYLMSTHASGVSDRFSGSGSGTDFTLEISRVKAEDVGVYYCQQLVDYPLTFGAGTKLELK | 386 |
| V_L-14 | DIVMTQAAFSNPVTLGTSASISCRSSKSLLHSDGITYLYWYLQRPGQSPQLLIYRMSNLASGVPDRFSGSGSGTDFTLRISRVEAEDVGVYYCAQMLEFPLTFGAGTKLELK | 387 |
| V_L-15 | DIVMTQSPLSLPVTPGEPASISCRSSKSLLHSDGITYLYWYLQKPGQSPQLLIYRMSNLASGVPDRFSGSGSGTDFTLKISRVEAEDVGVYYCAQMLEFPLTFGQGTKLEIK | 388 |
| V_L-16 | DVVMTQTPLTLSVTIGQPASISCKSSQSLLYTDGKTYLSWFLQRPGQSPKRLIYLVSKLDSGVPDRFSGSGSGTDFTLKISRVEAEDLGVYYCLQSTHFPLTFGAGTKLEVKR | 389 |

Figure 16

| | SEQUENCE | SEQ ID NO: |
|---|---|---|
| V<sub>L</sub>-17 | SIVMTQTPKFLLVSAGDRVTITCKASQSVSNDVAWYQQKPGQSPKLLIYYASNRYTGVPDRFTGSGYGTDFTFTISTVQAEDLAVYFCQQDYTSPYTFGGGTKLEIKR | 390 |
| V<sub>L</sub>-18 | DIQMTQTTSSLSASLGDRVTISCSASQGISNYLNWYQQKPDGTVKLLIYYTSSLHSGVPSRFSGSGSGTDYSLTISNLEPEDIATYYCQQYSELPYTFGSGTKLEIKR | 391 |
| V<sub>L</sub>-19 | DIVMTQSHKFMSTSVGDRVSITCKASQDVSTAVAWYQQKPGQSPKLLIYWASTRHTGVPDRFTGSGSGTDYTLTISSVQAEDLALYYCQQHYTTPLTFGAGTKLELKR | 392 |
| V<sub>L</sub>-20 | DIVMTQSQKFMSTSVGERVSITCKASQNVGTNVAWYQQKAGQSLELLIYGASNRHTGVPDRFTGSGSGTDFTLTITNVQSEDMTNYFCEQYSNFPLTFGAGTKLELKR | 393 |
| V<sub>L</sub>-21 | DVVMTQTPLTLSVTIGQPASISCKSSQSLFHSDGKTYLNWLLQRPGQSPKRLIYLVSKLDSGVPDRFTGSGSGTDFTPKISRVEDEDLGVYYCWQGTHFPLTFGAGTKLEMKR | 394 |
| V<sub>L</sub>-22 | DIQMNQSPSSLSASLGDTISITCRASQNINIWLSWYQQKPGNIPQLLIYKASNLHTGVPSRFSGSGSGTDFTLTISSLQPEDIATYYCLQGQSYPLTFGAGTKLVMKR | 395 |
| V<sub>L</sub>-23 | DVVMTQTPLTLSVTIGQPASISCKSSQSLLHSDGKTYLNWLLQRPGQPPKRLMYLVSTLDSGVPDRFTGSGSGTDFTLKISRVEAEDLGVYYCWQGTHFPLTFGAGTKPER | 396 |
| V<sub>L</sub>-24 | DIVMTQAAFSNPVTLGTSASISCRSSKSLLHSDGITYFYWYLQRPGQSPQLLIYRMSNLASGVPDRFSGSGSGTDFTLRISRVEAEDVGVYYCAQMLEFPLTFGAGTKLER | 397 |
| V<sub>L</sub>-25 | DIVMTQSHKFMSTSVGDRVSITCKASQDVRTAVAWYQQKPGQSPKLLIYWASTRHTGVPDRFTGSGSGTDFTLTLSNVQSEDLADYFCQQYSSYPWTFGGGTKLEIKR | 398 |
| V<sub>L</sub>-26 | NIWLTQSPSSLAVSAGEMVTMTCKSSQSVLYSSNQKNYLAWYQQKPGQSPKLLIYWASTRESGVPDRFTGSGSGTDFSLTISSVQAEDLAVYYCHQYLSSLTFGAGTKLELK | 399 |
| V<sub>L</sub>-27 | NIMMTQSPSSLAVSAGEKVTMSCKSSQSVLYSSNQKNYLAWYQQKPGQSPKLLIYWASTRESGVPDRFTGSGSGTDFTLTISSVQPEDLAVYYCHQYLSSLTFGAGTKLELK | 400 |
| V<sub>L</sub>-28 | NIMMTQSPSSLAVSAGQKVTMSCKSSQSVLYSSSQKNYLAWYQQKPGQSPKLLIYWASTRESGVPDRFSGSGSGTDFTLTISSVQPEDLAVYYCHQYLSSLTFGAGTKLELK | 401 |
| V<sub>L</sub>-29 | DVVMTQTPLSLPVSLGDQASISCRSSQSLVHNSGNTYLHWYLQRPGQSPNLLIYKVSNRFSGVPDRFSGSGSGTDFTLKISRVAAEDLGVYFCSQSTHVPPTFGGGTKLEIK | 402 |
| V<sub>L</sub>-30 | QAVVTQESALTTSPGETVTLTCRSSTGAVTTSNYANWVQEKPDHLFTGLIGGINNRVPGVPARFSGSLIGDKAALTITGAQTEDEAIYFCALWYSNHWVFGGGTKLTVL | 403 |
| V<sub>L</sub>-31 | DIVMTQAAFSNPVTLGTSASISCRSSKSLLHTNGITFLYWYLQKPGQSPQPLIYQMSNLASGVPDRFSSSGSGTDFTLRISRVEAEDVGVYYCAQNLELPWTFGGGTKLEIN | 404 |
| V<sub>L</sub>-32 | NIMMTQSPSSLAVSAGEKVTMSCKSSQSVLYSSNQKNYLAWYQQKPGQSPKLLIYWASTRESGVPDRFTGSGSGTDFTLTISSVQAEDLAVYYCHQYLSSLTFGAGTKLELK | 405 |

Figure 16 cont.

| | SEQUENCE | SEQ ID NO: |
|---|---|---|
| V$_L$-33 | DIVMTQSPSSLAMSVGQKVTMSCKSSQSLLNSSNQKNYLAWYQQKPGQSPKL LVYFASTRESGVPDRFIGSGSGTDFTLTISSVQAEDLADYFCQQHYSTPYTFGG GAKLEIK | 406 |
| V$_L$-34 | DIRMTQSPSSLSASLGDTITITCHASQNINVWLSWYQQKPGNIPKLLIYKASNLH TGVPSRFSGSGSGTGFTLTISSLQPEDIATYYCQQGQSYPYTFGGGTKLELK | 407 |
| V$_L$-35 | EIVLTQSPASLSVTTGEKVTIRCITSIDIDDDMNWYQQKPGEPPKLLISEGNTLRP GVPSRFSSSGYGTDFVFTIENTLSEDVADYYCLQSDNKPLTFGAGTKLELK | 408 |
| V$_L$-36 | DIQVIQSPSSLSASLGDTITITCHASQNINVWLSWYQQKPGNIPKLLIYKASNLH TGVPSRFSGSGSGTGFTLTISSLQPEDIATYYCQQGQSYPYTFGGGTKLELK | 409 |
| V$_L$-37 | EIKMNQSPSSLSASLGDTITITCHASQNINVWLSWYQQKPGNIPKLLIYKASNLH TGVPSRFSGSGSGTGFTLTISSLQPEDIATYYCQQGQSYPYTFGGGTKLELK | 410 |
| V$_L$-38 | QAVVTQESALTTSPGETVTLTCRSSTGAVTTSNYANWVQEKPDHLFTGLIGGT NNRAPGVPARFSGSLIGDKAALTITGAQTEDEAIYFCALWYSNHLVFGGGTKL TVL | 411 |
| V$_L$-39 | DVLMTQTPLSLPVSLGDQASISCRSSQDIVHSSGNTYLEWYLQKPGQSLKLLIY KVSNRFSGVPDRFSASGSGTDFTLKISRVEAEDLGVYYCFQGSHVPPTFGSGTK LEIK | 412 |
| V$_L$-40 | DIGMRQAAFSNPVTLGTSASISCRSSKSLLYSNGITYLYWFLQKPGQSPQLLIYQ MSNLASGVPDRFSSSGSGTDFTLRISRVEADDVGVYYCAQNLELPWTFGGGTK LEIK | 413 |
| V$_L$-41 | DIVLTQSPASLGVSLGQRATISCRASKSVSTSGYSYMHWYQQKPGQPPKLLIYL ASILESGVPARFSGSGSGTDFTLNIHPVEEEDAAIYYCQHSRELPLTFGAGTKLE LK | 414 |
| V$_L$-42 | NIVLTQSPASLAVSLGQRATISCRASESVDSYGNSFMHWYQQKPGQPPKLLIYL ASNLESGVPARFSGSGSRTDFTLTIDPVEADDAATYYCQQNNEDPWTFGGGTK LEIK | 415 |
| V$_L$-43 | DVVMTQTPLTLSVTIGQPASISCKSSQSLLYSNGKTYLNWLLQRPGQSPKRLIY LVSKLDSGVPDRFTGSGSGTDFTLKISRVEAEDLGVYYCVQGTHFPQTFGGGT KLEIK | 416 |
| V$_L$-44 | DILMTQSPSSMSVSLGDTVSITCHASQGINSNIGWLQQKPGKSFKGLIYHGTNL EDGVPSRFSGSGSGADYSLTISSLESEDFADYYCVQYDQFPWTFGGGTKLEIK | 417 |
| V$_L$-45 | DIVMSQSPASLGVSLGQRATISCRASKSVSTSGYSYMHWYQQKPGQPPKLLIY LASILESGVPARFSGSGSGTDFTLNIHPVEEEDAAIYYCQHSRELPLTFGAGTKL ELK | 418 |
| V$_L$-46 | DIVLTQSPASLAVSLGQRATISCRASKSVSTSGYSYMHWYQQKPGQPPKLLIYL ASILESGVPARFSGSGSGTDFTLNIHPVEEEDAATYYCQHSRELPLTFGAGTKLE LK | 419 |
| V$_L$-47 | DILMTQTPSSMSVSLGDTVSITCHASQGISSNIGWLQQKPRKSFKGLIYYGTNLE DGVPSRFSGSGSGADYSLTISSLESEDFADYYCVQYDQFPWTFGGGTKLEIK | 420 |
| V$_L$-48 | DIVLTQSPASLAVSLGQRATISCRASKSVSTSGYSCMHWYQQKPGQPPKLLIY ASNLESGVPARFSGGGSGTDFTLSIHPVEEEDAATYYCHHSTELPYTFGGGTKL EVE | 421 |

Figure 16 cont.

| | SEQUENCE | SEQ ID NO: |
|---|---|---|
| V$_L$-49 | DIVLTQSPASLAVSLGQRATISCRASESVDSYGNSFMHWYQQKPGQPPKLLIYLASNLESGVPARFSGSGSRTDFTLTIDPVEADDAATYYCQQNNEDPWTFGGGTKLEIK | 422 |
| V$_L$-50 | DVVMTQTPLTLSVTIGQPASISCKSSQSLLYSDGKTYLNWLLQRPGQSPKRLIYLVSQLDSGVPDRFTGSGSGTDFTLKISRVEADDLGVYCCVQGTHLPTFGGGTKLEIK | 423 |
| V$_L$-51 | DIVMTQSPASLAVSLGQRATISCRASESVENHVNSFMHWFQQKPGQPPKLLIYRASNLQSGIPARFSGSGSRTDFTLTINPVEADDVATYYCQQNNEVPYTFGGGTKLEIK | 424 |
| V$_L$-52 | QIVLSQSPAILSASPGEKVTMTCRASSSVTYMYWYQQKPGSSPQPWIYATSNLASGVPARFSGSGSGTSYSLTISRVEAEDAATYYCQQWSSNPLTFGAGTKLELK | 425 |
| V$_L$-53 | DIVLTQSPASLAVSLGQRATISCRASESLDNSGISFMNWFQQRPGQPPKLLIYAASNLESGVPARFSGSGSGTDFSLNIHPMEEDDAAMYFCQHSKEVPWTFGGGTKLEIK | 426 |
| V$_L$-54 | DIVMTQSHKIMSTSVGDRVSITCKASQDVSTTVAWFQQKPGQSPKLLLYWASTRHTGVPDRFTGSGSGTDYTLTISSVQAEDLALYYCQQHYSPPFTFGSGTKLEIK | 427 |
| V$_L$-55 | DIVMTQSQKFMSTSVGDRVSVTCKASQNVGINVAWYQQKPGQSPKALIYSASYRYSGVPDRFTGSGSGTDFTLTISNVQSEDLAEYFCQQYNSYPYTFGGGTKLEMK | 428 |
| V$_L$-56 | DVVMTQTPLTLSVTLGQPASISCRSSQSLLDSDGKTYLNWLLQRPGQSPKRLIYLVSRLDSGVPDRFTGSGSGTDFTLKISRVEAEDLGVYYCWQGTHFPFTFGGGTKLEIK | 429 |
| V$_L$-57 | DIRMTQSPASLSASVGETVTITCRASGNIHNYLAWYHQKQGKSPQLLVYNVKTLADGVPSRFSGSGSGTQFSLKINSLQPEDFGTYYCQHFWSIFPTFGGGTKLEIK | 430 |
| V$_L$-58 | QILLSQSPAILSASPGEKVTMTCRASSSVTYMYWYQQKPGSSPQPWIYATSNLASGVPARFSGSGSGTSYSLTISRVEAEDAATYYCQQWSSNPLTFGAGTKLELK | 431 |
| V$_L$-59 | DILMTQSPASLSASVGETVTITCRASGNIHNYLAWYQQKQGKSPQLLVYSAKTLADGVPSRFSGSGSGTQFSLKIDSLQPEDFGTYYCQHFWSLFPTFGGGTKLEIK | 432 |
| V$_L$-60 | DVVMTQTPKFLLVSAGDRVTITCKASQSVSSDVAWYQQKPGQSPKLLIYFASNRYTGVPDRFTGSGYGTDFTFTISTVQAEDLAVYFCQHNYISPFTFGGGTKLEIK | 433 |
| V$_L$-61 | DIVMTQSHKFMSTSVGDRVSITCKASQDVSTAVAWYQQKPGQSPKLLIYWASTRHTGVPDRFTGSGSGTDYTLTISSVQAEDLALYYCQQHYSTPYTFGGGTKLEIK | 434 |
| V$_L$-62 | DIAMTQSHKFMSTSVGDRVSITCKASQDVSTAVAWYQQKPGQSPKLLIYWASTRHTGVPDRFTGSGSGTDYTLTISSVQAEDLALYYCQQHYNTPYTFGGGTKLEIK | 435 |
| V$_L$-63 | DVGMTQTPLILSVTIGQPASISCKSSQSLLYINGKTYLNWLLQRPGQSPKRLIYLVSKLDSGVPNRFSGSGSGTDFTLKISRVEAEDLGVYYCLQSTHFPQTFGGGTKLEIK | 436 |

Figure 16 cont.

| | SEQUENCE | SEQ ID NO: |
|---|---|---|
| V$_L$-64 | DILLTQSPSSMSVSLGDTVSITCHASQGINSNIGWLQQKPGKSFKGLIYHGTNLE DGVPSRFSGSGSGADYSLTISSLESEDFADYYCVQYDQFPWTFGGGTKLEIK | 437 |
| V$_L$-65 | DIVMTQAAPSVPVTPGESVSISCRSSRSLLHSNGYTYLYWFLQRPGQSPRLLIYR MSNLASGVPDRFSGSGSGTAFTLRISRVEAEDVGVYYCMQHLEYPYTFGGGT KLEIK | 438 |
| V$_L$-66 | DIQMTQTTSSLSASLGDRVTISCSASQGISNYLNWYQQKPDGTVKLLIYYTSSL HSGVPSRFSGSGSGTDYSLTISNLEPEDIATYYCQQYSKLPRTFGGGTKLEIN | 439 |
| V$_L$-67 | DVVMTQTPLTLSVTIGQPASISCKSSRSLLDSDGKTYLNWLLQRPGQSPKRLIY LVSKLDSGVPDRFTGSGSGTDFTLKISRVEAEDLGVYYCWQGTHFPQTFGGGT KLEIN | 440 |
| V$_L$-68 | DIQMNQSPSSLSASLGDTITITCHASQNINVWLSWYQQKPGNIPKLLIYQASNL HTGVPSRFSGRGSGTGFTLTISSLQPEDIATYYCQQGQSSPFTFGSGTKLEIK | 441 |
| V$_L$-69 | DILMTQSHKFMSTSVGDRVSITCKASQDVSSVVVWYQQKPGQSPKQLIYWAS TRHTGVPDRFTGSGSGTDYTLTISSVQAEDLALYYCQQHYSTPYTFGGGTKLEI K | 442 |
| V$_L$-70 | QAVVTQESALTTSPGETVTLTCRSSTGAVTTSNYANWDQEKPDHLFTGLIGGT NNRAPGVPARFSGSLIGDKAALTITGAQTEDEAIYFCALWYSNHLVFGGGTKV TVL | 443 |
| V$_L$-71 | DIVMTQSPASLPVSLGQRATISCRASKSVTTSAYSYIHWYQQRPGQPPKLLIYL ASNLESGVPARFSGSGSGTDFTLNIHPVEEEDAATYYCQHNRELPPTFGGGTKL EIN | 444 |
| V$_L$-72 | DIVLTQSPATLSVTPGDSVSFSCRASQIINNNLHWYQQKSHESPRLLIRYTSQSIS GIPSRFSGSGSGTDFTLSINNVETEDFGMYFCQQTNSWPLTFGAGTKLELK | 445 |
| V$_L$-73 | DVVMTQTPLTLSVTIEQTASISCKSSQSLLDRDGKTYLNWLLQRPGQSPKRLIY LVSKLDSGVPDRFTGSGSGTDFTLKISRVEAEDLGVYYCWQGTHFPTFGGGTK LEIK | 446 |
| V$_L$-74 | DVVMTQTPKFLPITAEDRVTITCKASQSVSNEVAWYQQKPGQSPKLLIYYASN RYTGVPDRFTGSGSGTDFTFTIRSVQLEDLAVYFCQQHYSSPWTFGGGTKLEIK | 447 |
| V$_L$-75 | DVVMTQTPLTLSVTIGQPASISCKSSQSLFHSDGKTYLNWLLQRPGQSPKRLIY LVSKLDSGVPDRFTGSGSGTDFTLKISRVEAEDLGVYYCWQGTHFPLTFGAGT KLEMK | 823 |
| V$_L$-76 | DVVMTQTPLTLSVTIGQPASISCKSSQSLLHSDGKTYLNWLLQRPGQPPKRLM YLVSTLDSGVPDRFTGSGSGTDFTLKISRVEAEDLGVYYCWQGTHFPLTFGAG TKPELK | 824 |
| V$_L$-77 | DIVMTQAAFSNPVTLGTSASISCRSSKSLLHSDGITYFYWYLQRPGQSPQLLIYR MSNLASGVPDRFSGSGSGTDFTLRISRVEAEDVGVYYCAQMLEFPLTFGAGTK LERA | 825 |

Figure 16 cont.

Exemplary heavy chain variable region and light chain variable region combinations and their association with various exemplary anti-Gal3 antibodies

| Antibody name | VH Sequence | VL Sequence |
|---|---|---|
| TB001 (IMT001; IMT001-4) | 297 | 374 |
| TB006 (4A11.H3L1; IMT006; IMT006a) | 298 | 375 |
| 12G5.D7 | 299 | 376 |
| 13A12.2E5 | 300 | 377 |
| 14H10.2C9 | 301 | 378 |
| 15F10.2D6 | 302 | 379 |
| 19B5.2E6 | 303 | 380 |
| 20D11.2C6 | 304 | 381 |
| 20H5.A3 | 305 | 382 |
| 23H9.2E4 | 303 | 380 |
| 2D10.2B2 | 306 | 383 |
| 3B11.2G2 | 300 | 384 |
| 7D8.2D8 | 307 | 385 |
| mTB001 (mIMT001) | 308 | 386 |
| 4A11.2B5 | 309 | 387 |
| 4A11.H1L1 (IMT006b) | 310 | 375 |
| 4A11.H4L2 (IMT006c) | 311 | 388 |
| 4G2.2G6 | 312 | 389 |
| 6B3.2D3 | 313 | 390 |
| 6H6.2D6 | 314 | 391 |
| 9H2.2H10 | 315 | 392 |
| 13G4.2F8 | 316 | 393 |
| 13H12.2F8 | 317 | 394 |
| 15G7.2A7 | 318 | 395 |
| 19D9.2E5 | 319 | 396 |
| 23B10.2B12 | 320 | 397 |
| 24D12.2H9 | 321 | 398 |
| F846C.1B2 | 322 | 399 |
| F846C.1F5 | 323 | 400 |
| F846C.1H12 | 324 | 401 |

Figure 17

| Antibody name | VH Sequence | VL Sequence |
|---|---|---|
| F846C.1H5 | 325 | 402 |
| F846C.2H3 | 323 | 400 |
| F846TC.14A2 | 326 | 403 |
| F846TC.14E4 | 327 | 404 |
| F846TC.16B5 | 328 | 405 |
| F846TC.7F10 | 329 | 406 |
| F847C.10B9 | 330 | 407 |
| F847C.11B1 | 331 | 408 |
| F847C.12F12 | 332 | 409 |
| F847C.26F5 | 330 | 410 |
| F847C.4B10 | 333 | 411 |
| F849C.8D10 | 334 | 412 |
| F849C.8H3 | 335 | 413 |
| 846.2B11 | 336 | 414 |
| 846.4D5 | 337 | 415 |
| 846T.1H2 | 338 | 416 |
| 847.14H4 | 339 | 411 |
| 846.2D4 | 340 | 415 |
| 846.2F11 | 341 | 417 |
| 846T.10B1 | 342 | 418 |
| 846T.2E3 | 343 | 419 |
| 846T.4C9 | 344 | 420 |
| 846T.4E11 | 345 | 421 |
| 846T.4F5 | 346 | 422 |
| 846T.8D1 | 347 | 419 |
| 847.10C9 | 348 | 423 |
| 847.11D6 | 349 | 424 |
| 847.15D12 | 350 | 411 |
| 847.15F9 | 351 | 425 |
| 847.15H11 | 352 | 426 |

Figure 17 cont.

| Antibody name | VH Sequence | VL Sequence |
|---|---|---|
| 847.20H7 | 353 | 427 |
| 847.21B11 | 354 | 428 |
| 847.27B9 | 355 | 429 |
| 847.28D1 | 356 | 430 |
| 847.2B8 | 357 | 431 |
| 847.3B3 | 358 | 432 |
| 849.1D2 | 359 | 433 |
| 849.2D7 | 360 | 434 |
| 849.2F12 | 361 | 435 |
| 849.4B2 | 362 | 436 |
| 849.4F12 | 363 | 437 |
| 849.4F2 | 364 | 436 |
| 849.5C2 | 365 | 438 |
| 849.8D12 | 366 | 439 |
| F847C.21H6 | 367 | 440 |
| 849.5H1 | 368 | 441 |
| 847.23F11 | 369 | 442 |
| 847.16D10 | 370 | 443 |
| 847.13E2-mH0mL1 | 371 | 444 |
| 847.13E2-mH0mL2 | 371 | 445 |
| 847.12C4 | 372 | 446 |
| 847.4D3 | 373 | 447 |
| 2D10-VH0-VL0 | 828 | 383 |

Figure 17 cont.

Heavy chain and light chain sequences of exemplary anti-Gal3 antibodies

| Antibody name | Heavy chain sequence | SEQ ID NO: | Light chain sequence | SEQ ID NO: |
|---|---|---|---|---|
| TB001 (IMT001; IMT001-4) | QVQLVQSGSELKKPGASVKVSCKASGYTFTNY GMNWVRQAPGQGLKWMGWINTNTGEPTYVEE FTGRFVFSLETSVSTAYLQISSLKAEDTAVYFCA PYDNFFAYWGQGTTVTVSSASTKGPSVFPLAPC SRSTSESTAALGCLVKDYFPEPVTVSWNSGALT SGVHTFPAVLQSSGLYSLSSVVTVPSSSLGTKTY TCNVDHKPSNTKVDKRVESKYGPPCPPCPAPEF LGGPSVFLFPPKPKDTLMISRTPEVTCVVVDVSQ EDPEVQFNWYVDGVEVHNAKTKPREEQFNSTY RVVSVLTVLHQDWLNGKEYKCKVSNKGLPSSI EKTISKAKGQPREPQVYTLPPSQEEMTKNQVSL TCLVKGFYPSDIAVEWESNGQPENNYKTTPPVL DSDGSFFLYSRLTVDKSRWQEGNVFSCSVMHE ALHNHYTQKSLSLSLG | 448 | DIVLTQSPLSLPVTPGEP ASISCRSSKSLLYKDGK TYLNWFLQKPGQSPQL LIYLMSTHASGVPDRFS GSGSGTDFTLKISRVEA EDVGVYYCQQLVDYPL TFGGGTKLEIKRTVAAP SVFIFPPSDEQLKSGTAS VVCLLNNFYPREAKVQ WKVDNALQSGNSQESV TEQDSKDSTYSLSSTLT LSKADYEKHKVYACEV THQGLSSPVTKSFNRGE C | 495 |
| TB006 (4A11.H3L1; IMT006; IMT006a) | QVQLVQSGAEVKKPGASVKVSCKASGYSFTNY YMHWVRQAPGQRLEWMGWIYPGSGNTNYNE KFQGRVTITADTSASTAYMELSSLRSEDTAVYY CSTAPGGFDVWGQGTTVTVSSASTKGPSVFPLA PCSRSTSESTAALGCLVKDYFPEPVTVSWNSGA LTSGVHTFPAVLQSSGLYSLSSVVTVPSSSLGTK TYTCNVDHKPSNTKVDKRVESKYGPPCPPCPAP EFLGGPSVFLFPPKPKDTLMISRTPEVTCVVVDV SQEDPEVQFNWYVDGVEVHNAKTKPREEQFNS TYRVVSVLTVLHQDWLNGKEYKCKVSNKGLPS SIEKTISKAKGQPREPQVYTLPPSQEEMTKNQVS LTCLVKGFYPSDIAVEWESNGQPENNYKTTPPV LDSDGSFFLYSRLTVDKSRWQEGNVFSCSVMH EALHNHYTQKSLSLSLG | 449 | DIVMTQTPLSLSVTPGQ PASISCKSSKSLLHSDGI TYLYWYLQKPGQSPQL LIYRMSNLASGVPDRFS GSGSGTDFTLKISRVEA EDVGVYYCAQMLEFPL TFGQGTKLEIKRTVAAP SVFIFPPSDEQLKSGTAS VVCLLNNFYPREAKVQ WKVDNALQSGNSQESV TEQDSKDSTYSLSSTLT LSKADYEKHKVYACEV THQGLSSPVTKSFNRGE C | 496 |
| 12G5.D7 | QVQLKQSGAELVRPGASVKLSCKASGYTFTDY YINWVKQRPGQGLEWIARIYPGTGNTDYNEKF KGRATLTAEKSSSTAYMQLSSLTSEDSAVYFCA RFAYYYGSGGYFDYWGHGTTLTVSSAKTTPPS VYPLAPVCGDTTGSSVTLGCLVKGYFPEPVTLT WNSGSLSSGVHTFPAVLQSDLYTLSSSVTVTSST WPSQSITCNVAHPASSTKVDKKIEPRGPTIKPCP PCKCPAPNAAGGPSVFIFPPKIKDVLMISLSPIVT CVVVDVSEDDPDVQISWFVNNVEVHTAQTQTH REDYNSTLRVVSALPIQHQDWMSGKEFKCKVN NKDLGAPIERTISKPKGSVRAPQVYVLPPPEEEM TKKQVTLTCMVTDFMPEDIYVEWTNNGKTELN YKNTEPVLDSDGSYFMYSKLRVEKKNWVERNS YSCSVVHEGLHNHHTTKSFSRTPGK | 450 | DILMTQSPSSMSVSLGD TVSITCHASQGINSNMG WLQQKPGKSFKGLIYH ATNLEDGVPSRFSGSGS GADYSLTISSLESEDFA DYYCVQYAQFPPTFGS GTKLEIKRADVAPTVSI FPPSSEQLTSGGASVVC FLNNFYPKDINVKWKI DGSERQNGVLNSWTDQ DSKDSTYSMSSTLTLTK DEYERHNSYTCEATHK TSTSPIVKSFNRNEC | 497 |

Figure 18

| Antibody name | Heavy chain sequence | SEQ ID NO: | Light chain sequence | SEQ ID NO: |
|---|---|---|---|---|
| 13A12.2E5 | QIQLVQSGPELKKPGETVKISCKTSGYKFKTYVMSWVKQAPGKALKWMGWINTYSGVPTYADDFKGRFAFSLETSASTAYLEIINLKNEDTATYFCARDGNYGDPMDYWGQGTSVTVSSAKTTPPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNAAGGPSVFIFPPKIKDVLMISLSPIVTCVVVDVSEDDPDVQISWFVNNVEVHTAQTQTHREDYNSTLRVVSALPIQHQDWMSGKEFKCKVNNKDLGAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK | 451 | DVVMTQTPLTLSVAIGQPASISCKSSQSLLYTNGKTYLNWLLQRPGQSPKRLIYLLSKLDSGVPDRFSASGSGTDFTLKISRVEAEDLGVYYCLQSTHFPLTFGAGTKLEMKRADVAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC | 498 |
| 14H10.2C9 | QIQLVQSGPELKKPGETVKISCKASGYTFTTYGMGWVKQAPGKDLKWMGWINTYSGVPTYADDFKGRFAFSLETSASTAYLQISNLKNEDTATYFCSTPYEYDGAYWGQGTLVTVSAAKTTPPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNAAGGPSVFIFPPKIKDVLMISLSPIVTCVVVDVSEDDPDVQISWFVNNVEVHTAQTQTHREDYNSTLRVVSALPIQHQDWMSGKEFKCKVNNKDLGAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK | 452 | DVVMTQTPLTLSVTIGQPASISCKSSQSLFDSDGKTYLNWLLQRPGQSPKRLIYLVSKLDSGVPDRFTGSGSGTDFTLKISRVEAEDLGVYYCWQGTHFPLTFGAGTKLEMKRADVAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC | 499 |
| 15F10.2D6 | EVQLVESGGGLVKPGGSLKLSCAASGFAFSSYAMSWVRQTPEKRLEWVATISDGGVYTYYTDHVKGRFTISRDNAEDNLYLQMSHLKSEDTAMYYCVRDGGYWGQGTTLTVSSAKTTPPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNAAGGPSVFIFPPKIKDVLMISLSPIVTCVVVDVSEDDPDVQISWFVNNVEVHTAQTQTHREDYNSTLRVVSALPIQHQDWMSGKEFKCKVNNKDLGAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK | 453 | DVLMTQTPLSLPVSLGDQASISCRSSQSIVHNNGNTYLEWYLQKPGQSPKLLIYKVSNRFSGVPDRFSGSGSGTDFTLKISRVEAEDLGVYYCFQGSHVPLTFGGGTKLELKRADVAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC | 500 |

Figure 18 cont.

| Antibody name | Heavy chain sequence | SEQ ID NO: | Light chain sequence | SEQ ID NO: |
|---|---|---|---|---|
| 19B5.2E6 | QIQLVQSGPELKKPGETVKISCKASGYTFTTYAMSWVKQAPGKGLKWMGWINTYSGVPTYADDLKGRFAFSLETSASTAYLQINNLKNEDTATYFCARGPYAMDYWGQGTSVTVSSAKTTPPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNAAGGPSVFIFPPKIKDVLMISLSPIVTCVVVDVSEDDPDVQISWFVNNVEVHTAQTQTHREDYNSTLRVVSALPIQHQDWMSGKEFKCKVNNKDLGAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK | 454 | DIQMTQTTSSLSASLGDRVTISCSASQGINNYLNWYQQKPDGTVKLLIYYASSLHSGVPSRFSGSGSGTDYSLTISNLEPEDIATYYCQQYSQVPYTFGSGTKLEIKRADVAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC | 501 |
| 20D11.2C6 | EVQLQQSGPELVKPGASVKISCKASGYTFTDFYINWVKQSHGKSLEWIGDINPKNGGINYNPKFKIKATLTVDKSSSTSYMDLRGLTSEDSAVYYCTSGYGFPYWGQGTLVTVSAAKTTPPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNAAGGPSVFIFPPKIKDVLMISLSPIVTCVVVDVSEDDPDVQISWFVNNVEVHTAQTQTHREDYNSTLRVVSALPIQHQDWMSGKEFKCKVNNKDLGAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK | 455 | DIQMNQSPSSLSASLGDTITITCRASQNIYIWLSWYQQKPGNIPKLLIYKASNLHTGVPSRFSGSGSGTDFTLTISTLQPEDIATYFCLQGQSYPLTFGAGTKLEMKRADVAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC | 502 |
| 20H5.A3 | QIQLVQSGPELKKPGESVKISCKASGYAFTTYGMSWVQQAPGKGLKWMGWVNTYSGVPTCADDFKGRFAFSLETSASTAYLQINNLRNEDTATYFCARGPYAMDYWGQGTSVTVSSAKTTPPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNAAGGPSVFIFPPKIKDVLMISLSPIVTCVVVDVSEDDPDVQISWFVNNVEVHTAQTQTHREDYNSTLRVVSALPIQHQDWMSGKEFKCKVNNKDLGAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK | 456 | DIQMTQTTSSLSASLGDRVTINCSASQDISNYLNWYQQKPDGTVKLLIYYTSSLLSGVPSRFSGSGSGTDYSLTISNLEPEDIATYFCQQYSKLPYTFGSGTHLEIKRADVAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC | 503 |

Figure 18 cont.

| Antibody name | Heavy chain sequence | SEQ ID NO: | Light chain sequence | SEQ ID NO: |
|---|---|---|---|---|
| 23H9.2E4 | QIQLVQSGPELKKPGETVKISCKASGYTFTTYAMSWVKQAPGKGLKWMGWINTYSGVPTYADDLKGRFAFSLETSASTAYLQINNLKNEDTATYFCARGPYAMDYWGQGTSVTVSSAKTTPPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNAAGGPSVFIFPPKIKDVLMISLSPIVTCVVVDSEDDPDVQISWFVNNVEVHTAQTQTHREDYNSTLRVVSALPIQHQDWMSGKEFKCKVNNKDLGAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK | 457 | DIQMTQTTSSLSASLGDRVTISCSASQGINNYLNWYQQKPDGTVKLLIYYASSLHSGVPSRFSGSGSGTDYSLTISNLEPEDIATYYCQQYSQVPYTFGSGTKLEIKRADVAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC | 501 |
| 2D10.2B2 | QVQLQQSGPELVKPGASVKISCKASGYTFTDYYINWVKQRPGQGLEWIGWIYPGSNDTKYNEKFKGKATLTVDTSSSTAYMQLGSLTSEDSAVYFCANYFGCSGWFFDVWGTGTTVTVSSAKTTPPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNAAGGPSVFIFPPKIKDVLMISLSPIVTCVVVDSEDDPDVQISWFVNNVEVHTAQTQTHREDYNSTLRVVSALPIQHQDWMSGKEFKCKVNNKDLGAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK | 458 | DIVMTQAAFSNPVTLGTSASISCRSSKSLLHSDGITYLYWYLQRPGQSPQLLIYRMSNLASGVPDRFSGSGSGTDFTLRISRVEAEDVGVYYCAQMIEFPLTFGAGTILELKRADVAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC | 504 |
| 3B11.2G2 | QIQLVQSGPELKKPGETVKISCKTSGYKFKTYVMSWVKQAPGKALKWMGWINTYSGVPTYADDFKGRFAFSLETSASTAYLEIINLKNEDTATYFCARDGNYGDPMDYWGQGTSVTVSSAKTTPPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNAAGGPSVFIFPPKIKDVLMISLSPIVTCVVVDSEDDPDVQISWFVNNVEVHTAQTQTHREDYNSTLRVVSALPIQHQDWMSGKEFKCKVNNKDLGAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK | 459 | DVVMTQTPLTLSVAIGQPASISCKSSQSLLYTNGKTYLNWLLQRPGQSPKRLIYLVSKLDSGVPDRFSGSGSGTDFTLKISRVEAEDLGVYYCLQSTHFPLTFGAGTKLELKRADVAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC | 505 |

Figure 18 cont.

| Antibody name | Heavy chain sequence | SEQ ID NO: | Light chain sequence | SEQ ID NO: |
|---|---|---|---|---|
| 7D8.2D8 | EVQLVESGGGLVKPGGSLKLSCAASGFTFSSYA MSWVRQTPEKRLEWVATISDGGIYTYYPDNVKG RFTISRDNAKNNLFLQMSHLKSEDTAMYYCVRD GGYWGQGTTLTVSSAKTTPPSVYPLAPVCGDTT GSSVTLGCLVKGYFPEPVTLTWNSGSLSSGVHTF PAVLQSDLYTLSSSVTVTSSTWPSQSITCNVAHP ASSTKVDKKIEPRGPTIKPCPPCKCPAPNAAGGPS VFIFPPKIKDVLMISLSPIVTCVVVDSEDDPDVQI SWFVNNVEVHTAQTQTHREDYNSTLRVVSALPI QHQDWMSGKEFKCKVNNKDLGAPIERTISKPKG SVRAPQVYVLPPPEEEMTKKQVTLTCMVTDFMP EDIYVEWTNNGKTELNYKNTEPVLDSDGSYFMY SKLRVEKKNWVERNSYSCSVVHEGLHNHHTTKS FSRTPGK | 460 | DVLMTQTPLSLPVSLGD QASISCRSSQSIVHSNGN TYLEWYLQKPGQSPKLL IYKVSNRFSGVPDRFSGS GSGTDFTLKISRVEAEDL GVYYCFQGSHVPLTFGA GTKLELKRADVAPTVSIF PPSSEQLTSGGASVVCFL NNFYPKDINVKWKIDGS ERQNGVLNSWTDQDSK DSTYSMSSTLTLTKDEY ERHNSYTCEATHKTSTS PIVKSFNRNEC | 506 |
| mTB001 (mIMT001) | QIQLVQSGPELKKPGETVKISCKASGYTFTNYGM NWVKQAPGKGLKWMGWINTNTGEPTYVEEFKG RFAFSLETSASTAYLQINNLKNEDTATYFCAPYD NFFAYWGQGTLVTVSAAKTTPPSVYPLAPVCGD TTGSSVTLGCLVKGYFPEPVTLTWNSGSLSSGVH TFPAVLQSDLYTLSSSVTVTSSTWPSQSITCNVAH PASSTKVDKKIEPRGPTIKPCPPCKCPAPNAAGGP SVFIFPPKIKDVLMISLSPIVTCVVVDSEDDPDV QISWFVNNVEVHTAQTQTHREDYNSTLRVVSAL PIQHQDWMSGKEFKCKVNNKDLGAPIERTISKPK GSVRAPQVYVLPPPEEEMTKKQVTLTCMVTDFM PEDIYVEWTNNGKTELNYKNTEPVLDSDGSYFM YSKLRVEKKNWVERNSYSCSVVHEGLHNHHTT KSFSRTPGK** | 461 | DIVITQDELSNPVTSGES VSISCRSSKSLLYKDGKT YLNWFLQRPGQSPQLLI YLMSTHASGVSDRFSGS GSGTDFTLEISRVKAEDV GVYYCQQLVDYPLTFG AGTKLELKRADVAPTVS IFPPSSEQLTSGGASVVC FLNNFYPKDINVKWKID GSERQNGVLNSWTDQD SKDSTYSMSSTLTLTKD EYERHNSYTCEATHKTS TSPIVKSFNRNEC** | 507 |
| 4A11.2B5 | QVQLQQSGPELVKPGASVKISCKASGYSFTNYYI HWVKQRPGQGLEWIGWIYPGSGNTNYNEKFKG KATLTADTSSSTTNMQLSSLTSEDSAVYYCSTAP GGFDVWGSGTTVTVSSASTKGPSVFPLAPCSRST SESTAALGCLVKDYFPEPVTVSWNSGALTSGVH TFPAVLQSSGLYSLSSVVTVPSSSLGTKTYTCNV DHKPSNTKVDKRVESKYGPPCPPCPAPEFLGGPS VFLFPPKPKDTLMISRTPEVTCVVVDVSQEDPEV QFNWYVDGVEVHNAKTKPREEQFNSTYRVVSV LTVLHQDWLNGKEYKCKVSNKGLPSSIEKTISKA KGQPREPQVYTLPPSQEEMTKNQVSLTCLVKGF YPSDIAVEWESNGQPENNYKTTPPVLDSDGSFFL YSRLTVDKSRWQEGNVFSCSVMHEALHNHYTQ KSLSLSLG** | 462 | DIVMTQAAFSNPVTLGT SASISCRSSKSLLHSDGIT YLYWYLQRPGQSPQLLI YRMSNLASGVPDRFSGS GSGTDFTLRISRVEAEDV GVYYCAQMLEFPLTFGA GTKLELKRTVAAPSVFIF PPSDEQLKSGTASVVCL LNNFYPREAKVQWKVD NALQSGNSQESVTEQDS KDSTYSLSSTLTLSKADY EKHKVYACEVTHQGLSS PVTKSFNRGEC* | 508 |

Figure 18 cont.

| Antibody name | Heavy chain sequence | SEQ ID NO: | Light chain sequence | SEQ ID NO: |
|---|---|---|---|---|
| 4A11.H1L1 (IMT006b) | QVQLVQSGAEVKKPGASVKVSCKASGYSFTNYY MHWVRQAPGQGLEWMGWIYPGSGNTNYNEKF QGRVTMTADTSISTAYMELSRLSDDTAVYYCS TAPGGFDVWGQGTTVTVSSASTKGPSVFPLAPCS RSTSESTAALGCLVKDYFPEPVTVSWNSGALTSG VHTFPAVLQSSGLYSLSSVVTVPSSSLGTKTYTC NVDHKPSNTKVDKRVESKYGPPCPPCPAPEFLGG PSVFLFPPKPKDTLMISRTPEVTCVVVDVSQEDPE VQFNWYVDGVEVHNAKTKPREEQFNSTYRVVS VLTVLHQDWLNGKEYKCKVSNKGLPSSIEKTISK AKGQPREPQVYTLPPSQEEMTKNQVSLTCLVKG FYPSDIAVEWESNGQPENNYKTTPPVLDSDGSFF LYSRLTVDKSRWQEGNVFSCSVMHEALHNHYT QKSLSLSLG | 463 | DIVMTQTPLSLSVTPGQP ASISCKSSKSLLHSDGIT YLYWYLQKPGQSPQLLI YRMSNLASGVPDRFSGS GSGTDFTLKISRVEAEDV GVYYCAQMLEFPLTFGQ GTKLEIKRTVAAPSVFIF PPSDEQLKSGTASVVCL LNNFYPREAKVQWKVD NALQSGNSQESVTEQDS KDSTYSLSSTLTLSKADY EKHKVYACEVTHQGLSS PVTKSFNRGEC | 509 |
| 4A11.H4L2 (IMT006c) | QVQLVQSGAEVKKPGASVKVSCKASGYSFTNYY IHWVRQAPGQRLEWMGWIYPGSGNTNYNEKFQ GRVTLTADTSASTTYMELSSLRSEDTAVYYCSTA PGGFDVWGQGTTVTVSSASTKGPSVFPLAPCSRS TSESTAALGCLVKDYFPEPVTVSWNSGALTSGV HTFPAVLQSSGLYSLSSVVTVPSSSLGTKTYTCN VDHKPSNTKVDKRVESKYGPPCPPCPAPEFLGGP SVFLFPPKPKDTLMISRTPEVTCVVVDVSQEDPE VQFNWYVDGVEVHNAKTKPREEQFNSTYRVVS VLTVLHQDWLNGKEYKCKVSNKGLPSSIEKTISK AKGQPREPQVYTLPPSQEEMTKNQVSLTCLVKG FYPSDIAVEWESNGQPENNYKTTPPVLDSDGSFF LYSRLTVDKSRWQEGNVFSCSVMHEALHNHYT QKSLSLSLG | 464 | DIVMTQSPLSLPVTGEP ASISCRSSKSLLHSDGITY LYWYLQKPGQSPQLLIY RMSNLASGVPDRFSGSG SGTDFTLKISRVEAEDVG VYYCAQMLEFPLTFGQG TKLEIKRTVAAPSVFIFPP SDEQLKSGTASVVCLLN NFYPREAKVQWKVDNA LQSGNSQESVTEQDSKD STYSLSSTLTLSKADYEK HKVYACEVTHQGLSSPV TKSFNRGEC | 510 |
| 4G2.2G6 | QIQLVQSGPDLKKPGETVKISCKASGYTFTTYVM SWVKQAPGKDLKWMGWINTHSGVPTYADDFK GRFDFSLETSANTAFLQINNLKNEDTATYFCTRD GNDGDAMDNWGQGTSVTVSSASTKGPSVFPLAP CSRSTSESTAALGCLVKDYFPEPVTVSWNSGALT SGVHTFPAVLQSSGLYSLSSVVTVPSSSLGTKTYT CNVDHKPSNTKVDKRVESKYGPPCPPCPAPEFLG GPSVFLFPPKPKDTLMISRTPEVTCVVVDVSQED PEVQFNWYVDGVEVHNAKTKPREEQFNSTYRV VSVLTVLHQDWLNGKEYKCKVSNKGLPSSIEKTI SKAKGQPREPQVYTLPPSQEEMTKNQVSLTCLV KGFYPSDIAVEWESNGQPENNYKTTPPVLDSDGS FFLYSRLTVDKSRWQEGNVFSCSVMHEALHNHY TQKSLSLSLG** | 465 | DVVMTQTPLTLSVTIGQ PASISCKSSQSLLYTDGK TYLSWFLQRPGQSPKRLI YLVSKLDSGVPDRFSGS GSGTDFTLKISRVEAEDL GVYYCLQSTHFPLTFGA GTKLEVKRTVAAPSVFIF PPSDEQLKSGTASVVCL LNNFYPREAKVQWKVD NALQSGNSQESVTEQDS KDSTYSLSSTLTLSKADY EKHKVYACEVTHQGLSS PVTKSFNRGEC* | 511 |

Figure 18 cont.

| Antibody name | Heavy chain sequence | SEQ ID NO: | Light chain sequence | SEQ ID NO: |
|---|---|---|---|---|
| 6B3.2D3 | QVQLKQSGPGLVQPSQSLSITCTVSGFSLTSYGV HWVRQPPGKGLEWLGVIWSGGSTDYNAAFISRL SISKDNSKSQVFFKMNSLQADDTAIYYCAKGPY DYDLGWFAYWGQGTLVTVSAASTKGPSVFPLAP CSRSTSESTAALGCLVKDYFPEPVTVSWNSGALT SGVHTFPAVLQSSGLYSLSSVVTVPSSSLGTKTYT CNVDHKPSNTKVDKRVESKYGPPCPPCPAPEFLG GPSVFLFPPKPKDTLMISRTPEVTCVVVDVSQED PEVQFNWYVDGVEVHNAKTKPREEQFNSTYRV VSVLTVLHQDWLNGKEYKCKVSNKGLPSSIEKTI SKAKGQPREPQVYTLPPSQEEMTKNQVSLTCLV KGFYPSDIAVEWESNGQPENNYKTTPPVLDSDGS FFLYSRLTVDKSRWQEGNVFSCSVMHEALHNHY TQKSLSLSLG** | 466 | SIVMTQTPKFLLVSAGD RVTITCKASQSVSNDVA WYQQKPGQSPKLLIYYA SNRYTGVPDRFTGSGYG TDFTFTISTVQAEDLAVY FCQQDYTSPYTFGGGTK LEIKRTVAAPSVFIFPPSD EQLKSGTASVVCLLNNF YPREAKVQWKVDNALQ SGNSQESVTEQDSKDST YSLSSTLTLSKADYEKH KVYACEVTHQGLSSPVT KSFNRGEC* | 512 |
| 6H6.2D6 | QIQLVQSGPELKKPGETVKISCKASGYTFTTYGM SWVKQAPGKGLKWMAWINTYSGVPTYADDFK GRFAFSLETSASTAYLQINNLTNEDTATYFCARG PYAMDYWGQGTSVTVSSASTKGPSVFPLAPCSR STSESTAALGCLVKDYFPEPVTVSWNSGALTSGV HTFPAVLQSSGLYSLSSVVTVPSSSLGTKTYTCN VDHKPSNTKVDKRVESKYGPPCPPCPAPEFLGGP SVFLFPPKPKDTLMISRTPEVTCVVVDVSQEDPE VQFNWYVDGVEVHNAKTKPREEQFNSTYRVVS VLTVLHQDWLNGKEYKCKVSNKGLPSSIEKTISK AKGQPREPQVYTLPPSQEEMTKNQVSLTCLVKG FYPSDIAVEWESNGQPENNYKTTPPVLDSDGSFF LYSRLTVDKSRWQEGNVFSCSVMHEALHNHYT QKSLSLSLG** | 467 | DIQMTQTTSSLSASLGDR VTISCSASQGISNYLNWY QQKPDGTVKLLIYYTSS LHSGVPSRFSGSGSGTD YSLTISNLEPEDIATYYC QQYSELPYTFGSGTKLEI KRTVAAPSVFIFPPSDEQ LKSGTASVVCLLNNFYP REAKVQWKVDNALQSG NSQESVTEQDSKDSTYS LSSTLTLSKADYEKHKV YACEVTHQGLSSPVTKS FNRGEC* | 513 |
| 9H2.2H10 | QVQLQQPGAELVGPGSSVKLSCKASGYTFTNYW IHWVKQRPLQGLEWIGNIDPSDSETHYNQKFKD KATLTVDKSSSTAYMQLSSLTSEDSAVYYCARH GYYDYWGQGTTLTVSSASTKGPSVFPLAPCSRST SESTAALGCLVKDYFPEPVTVSWNSGALTSGVH TFPAVLQSSGLYSLSSVVTVPSSSLGTKTYTCNV DHKPSNTKVDKRVESKYGPPCPPCPAPEFLGGPS VFLFPPKPKDTLMISRTPEVTCVVVDVSQEDPEV QFNWYVDGVEVHNAKTKPREEQFNSTYRVVSV LTVLHQDWLNGKEYKCKVSNKGLPSSIEKTISKA KGQPREPQVYTLPPSQEEMTKNQVSLTCLVKGF YPSDIAVEWESNGQPENNYKTTPPVLDSDGSFFL YSRLTVDKSRWQEGNVFSCSVMHEALHNHYTQ KSLSLSLG** | 468 | DIVMTQSHKFMSTSVGD RVSITCKASQDVSTAVA WYQQKPGQSPKLLIYW ASTRHTGVPDRFTGSGS GTDYTLTISSVQAEDLAL YYCQQHYTTPLTFGAGT KLELKRTVAAPSVFIFPP SDEQLKSGTASVVCLLN NFYPREAKVQWKVDNA LQSGNSQESVTEQDSKD STYSLSSTLTLSKADYEK HKVYACEVTHQGLSSPV TKSFNRGEC* | 514 |

Figure 18 cont.

| Antibody name | Heavy chain sequence | SEQ ID NO: | Light chain sequence | SEQ ID NO: |
|---|---|---|---|---|
| 13G4.2F8 | QVQLQQPGAELVKPGASVKLSCKASGYTFTSYW MHWVKQRPGQGLEWIGMIHPNSGSTDYNEKFK NKATLNVDKSSSTAYIQLSSLTSEDSAVYYCTRW GIYYYARDYWGQGTTLTVSSASTKGPSVFPLAPC SRSTSESTAALGCLVKDYFPEPVTVSWNSGALTS GVHTFPAVLQSSGLYSLSSVVTVPSSSLGTKTYT CNVDHKPSNTKVDKRVESKYGPPCPPCPAPEFLG GPSVFLFPPKPKDTLMISRTPEVTCVVVDVSQED PEVQFNWYVDGVEVHNAKTKPREEQFNSTYRV VSVLTVLHQDWLNGKEYKCKVSNKGLPSSIEKTI SKAKGQPREPQVYTLPPSQEEMTKNQVSLTCLV KGFYPSDIAVEWESNGQPENNYKTTPPVLDSDGS FFLYSRLTVDKSRWQEGNVFSCSVMHEALHNHY TQKSLSLSLG** | 469 | DIVMTQSQKFMSTSVGE RVSITCKASQNVGTNVA WYQQKAGQSLELLIYGA SNRHTGVPDRFTGSGSG TDFTLTITNVQSEDMTN YFCEQYSNFPLTFGAGT KLELKRTVAAPSVFIFPP SDEQLKSGTASVVCLLN NFYPREAKVQWKVDNA LQSGNSQESVTEQDSKD STYSLSSTLTLSKADYEK HKVYACEVTHQGLSSPV TKSFNRGEC* | 515 |
| 13H12.2F8 | QIQLVQSGPELKKPGETVKISCKASGYTFTTYGM SWVKQAPGKGLKWMGWINTYSGVPTYADDFK GRFAFSLETSASTAYLQINNLKNEDTATYFCAVP YEYDGAYWGQGTLVTVSAASTKGPSVFPLAPCS RSTSESTAALGCLVKDYFPEPVTVSWNSGALTSG VHTFPAVLQSSGLYSLSSVVTVPSSSLGTKTYTC NVDHKPSNTKVDKRVESKYGPPCPPCPAPEFLGG PSVFLFPPKPKDTLMISRTPEVTCVVVDVSQEDPE VQFNWYVDGVEVHNAKTKPREEQFNSTYRVVS VLTVLHQDWLNGKEYKCKVSNKGLPSSIEKTISK AKGQPREPQVYTLPPSQEEMTKNQVSLTCLVKG FYPSDIAVEWESNGQPENNYKTTPPVLDSDGSFF LYSRLTVDKSRWQEGNVFSCSVMHEALHNHYT QKSLSLSLG** | 470 | DVVMTQTPLTLSVTIGQ PASISCKSSQSLFHSDGK TYLNWLLQRPGQSPKRL IYLVSKLDSGVPDRFTGS GSGTDFTPKISRVEDEDL GVYYCWQGTHFPLTFG AGTKLEMKRTVAAPSVF IFPPSDEQLKSGTASVVC LLNNFYPREAKVQWKV DNALQSGNSQESVTEQD SKDSTYSLSSTLTLSKAD YEKHKVYACEVTHQGL SSPVTKSFNRGEC* | 516 |
| 15G7.2A7 | EVQLQQSGPELVKPGASVKISCKASGYTFTDYY MNWVKQSHGKSLEWIGDINPNNGGTNYNQKFK GKATLTVDKSSSTAYMELRSLTSEDSAVYYCTS GYGFPYWGQGTLVTVSAASTKGPSVFPLAPCSRS TSESTAALGCLVKDYFPEPVTVSWNSGALTSGV HTFPAVLQSSGLYSLSSVVTVPSSSLGTKTYTCN VDHKPSNTKVDKRVESKYGPPCPPCPAPEFLGGP SVFLFPPKPKDTLMISRTPEVTCVVVDVSQEDPE VQFNWYVDGVEVHNAKTKPREEQFNSTYRVVS VLTVLHQDWLNGKEYKCKVSNKGLPSSIEKTISK AKGQPREPQVYTLPPSQEEMTKNQVSLTCLVKG FYPSDIAVEWESNGQPENNYKTTPPVLDSDGSFF LYSRLTVDKSRWQEGNVFSCSVMHEALHNHYT QKSLSLSLG** | 471 | DIQMNQSPSSLSASLGDT ISITCRASQNINIWLSWY QQKPGNIPQLLIYKASNL HTGVPSRFSGSGSGTDFT LTISSLQPEDIATYYCLQ GQSYPLTFGAGTKLVMK RTVAAPSVFIFPPSDEQL KSGTASVVCLLNNFYPR EAKVQWKVDNALQSGN SQESVTEQDSKDSTYSLS STLTLSKADYEKHKVYA CEVTHQGLSSPVTKSFN RGEC* | 517 |

Figure 18 cont.

| Antibody name | Heavy chain sequence | SEQ ID NO: | Light chain sequence | SEQ ID NO: |
|---|---|---|---|---|
| 19D9.2E5 | QIQLVQSGPELKKPGETVKISCKASGYTFTTYGMGWVKQAPGKGLKWMGWINTYSGVPTYADDFKGRFAFSLETSTSTAYLQINNLKNEDMATYFCATPYEYDGAYWGQGTLVTVSAASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG** | 472 | DVVMTQTPLTLSVTIGQPASISCKSSQSLLHSDGKTYLNWLLQRPGQPPKRLMYLVSTLDSGVPDRFTGSGSGTDFTLKISRVEAEDLGVYYCWQGTHFPLTFGAGTKPERTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC* | 518 |
| 23B10.2B12 | QVQLQQSGPELVKPGDSVKISCKAAGYTFSDYYINWVKQRPGQGLEWIGWIYPVSVNTKYNEKFKGKATLTVDTSSSTAYMQLSSLTSEDSGVYFCAYLDYWGQGTLVTVSAASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG** | 473 | DIVMTQAAFSNPVTLGTSASISCRSSKSLLHSDGITYFYWYLQRPGQSPQLLIYRMSNLASGVPDRFSGSGSGTDFTLRISRVEAEDVGVYYCAQMLEFPLTFGAGTKLERTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC* | 519 |
| 24D12.2H9 | QVQLKQSGPGLVQPSQSLSITCTVSGFSLTSYGVHWVRQAPGKGLEWLGVIWSGGSTDYNAAFMSRLSISKDNSKSQVFFKMNSLQADDTAIYYCAKSPDGYDVAWFGYWGQGTLVTVSAASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG** | 474 | DIVMTQSHKFMSTSVGDRVSITCKASQDVRTAVAWYQQKPGQSPKLLIYWASTRHTGVPDRFTGSGSGTDFTLTLSNVQSEDLADYFCQQYSSYPWTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC* | 520 |

Figure 18 cont.

| Antibody name | Heavy chain sequence | SEQ ID NO: | Light chain sequence | SEQ ID NO: |
|---|---|---|---|---|
| F846C.1B2 | QIQLVQSGPELKKPGETVKISCKASGYTFTNYG MNWVKQAPGKGLWMGWINTYTGEPSYADD FKGRFAFSLETSASTAYLQINNLKNEDMATYFC ARWGGYAGDYYAMDFWGQGTSVTVSSASTKG PSVFPLAPCSRSTSESTAALGCLVKDYFPEPVTV SWNSGALTSGVHTFPAVLQSSGLYSLSSVVTVP SSSLGTKTYTCNVDHKPSNTKVDKRVESKYGPP CPPCPAPEFLGGPSVFLFPPKPKDTLMISRTPEVT CVVVDVSQEDPEVQFNWYVDGVEVHNAKTKP REEQFNSTYRVVSVLTVLHQDWLNGKEYKCKV SNKGLPSSIEKTISKAKGQPREPQVYTLPPSQEE MTKNQVSLTCLVKGFYPSDIAVEWESNGQPEN NYKTTPPVLDSDGSFFLYSRLTVDKSRWQEGNV FSCSVMHEALHNHYTQKSLSLSLG** | 475 | NIWLTQSPSSLAVSAGE MVTMTCKSSQSVLYSSN QKNYLAWYQQKPGQSP KLLIYWASTRESGVPDR FTGSGSGTDFSLTISSVQ AEDLAVYYCHQYLSSLT FGAGTKLELKRTVAAPS VFIFPPSDEQLKSGTASV VCLLNNFYPREAKVQW KVDNALQSGNSQESVTE QDSKDSTYSLSSTLTLSK ADYEKHKVYACEVTHQ GLSSPVTKSFNRGEC* | 521 |
| F846C.1F5 | QIQLVQSGPELKKPGETVKISCKASGYTFTNYG MNWVKQAPGKGLWMGWINTYTGEPSYADD FKGRFAFSLETSASTAYLQINNLKNEDMATYFC ARWGGYDGDYYAMDYWGQGTSVTVSSASTK GPSVFPLAPCSRSTSESTAALGCLVKDYFPEPVT VSWNSGALTSGVHTFPAVLQSSGLYSLSSVVTV PSSSLGTKTYTCNVDHKPSNTKVDKRVESKYGP PCPPCPAPEFLGGPSVFLFPPKPKDTLMISRTPEV TCVVVDVSQEDPEVQFNWYVDGVEVHNAKTK PREEQFNSTYRVVSVLTVLHQDWLNGKEYKCK VSNKGLPSSIEKTISKAKGQPREPQVYTLPPSQE EMTKNQVSLTCLVKGFYPSDIAVEWESNGQPE NNYKTTPPVLDSDGSFFLYSRLTVDKSRWQEGN VFSCSVMHEALHNHYTQKSLSLSLG** | 476 | NIMMTQSPSSLAVSAGE KVTMSCKSSQSVLYSSN QKNYLAWYQQKPGQSP KLLIYWASTRESGVPDR FTGSGSGTDFTLTISSVQ PEDLAVYYCHQYLSSLT FGAGTKLELKRTVAAPS VFIFPPSDEQLKSGTASV VCLLNNFYPREAKVQW KVDNALQSGNSQESVTE QDSKDSTYSLSSTLTLSK ADYEKHKVYACEVTHQ GLSSPVTKSFNRGEC* | 522 |
| F846C.1H12 | QIQLVQSGPELKKPGETVKISCKASGYTFTNFG MNWVKQAPGKGLWMGWINTYTGEPSYADD FKGRFAFSLETSASTAYLQINNLKNEDIATYFCA RWGGYAGDYYAMDYWGQGTSVTVSSASTKGP SVFPLAPCSRSTSESTAALGCLVKDYFPEPVTVS WNSGALTSGVHTFPAVLQSSGLYSLSSVVTVPS SSLGTKTYTCNVDHKPSNTKVDKRVESKYGPPC PPCPAPEFLGGPSVFLFPPKPKDTLMISRTPEVTC VVVDVSQEDPEVQFNWYVDGVEVHNAKTKPR EEQFNSTYRVVSVLTVLHQDWLNGKEYKCKVS NKGLPSSIEKTISKAKGQPREPQVYTLPPSQEEM TKNQVSLTCLVKGFYPSDIAVEWESNGQPENNY KTTPPVLDSDGSFFLYSRLTVDKSRWQEGNVFS CSVMHEALHNHYTQKSLSLSLG** | 477 | NIMMTQSPSSLAVSAGQ KVTMSCKSSQSVLYSSS QKNYLAWYQQKPGQSP KLLIYWASTRESGVPDR FSGSGSGTDFTLTISSVQ PEDLAVYYCHQYLSSLT FGAGTKLELKRTVAAPS VFIFPPSDEQLKSGTASV VCLLNNFYPREAKVQW KVDNALQSGNSQESVTE QDSKDSTYSLSSTLTLSK ADYEKHKVYACEVTHQ GLSSPVTKSFNRGEC* | 523 |

Figure 18 cont.

| Antibody name | Heavy chain sequence | SEQ ID NO: | Light chain sequence | SEQ ID NO: |
|---|---|---|---|---|
| F846C.1H5 | EVQLLESGGGLVKPGGSLKLSCAASGFTFSSYAMSWVRQTPEKRLEWVASISSSGGDTYYPDSVKGRFTISRDNARNILYLQMSSLRSEDTAMYYCASYGNSLFDYWGQGTTLTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG** | 478 | DVVMTQTPLSLPVSLGDQASISCRSSQSLVHNSGNTYLHWYLQRPGQSPNLLIYKVSNRFSGVPDRFSGSGSGTDFTLKISRVAAEDLGVYFCSQSTHVPPTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC* | 524 |
| F846C.2H3 | QIQLVQSGPELKKPGETVKISCKASGYTFTNYGMNWVKQAPGKGLKWMGWINTYTGEPSYADDFKGRFAFSLETSASTAYLQINNLKNEDMATYFCARWGGYDGDYYAMDYWGQGTSVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG** | 479 | NIMMTQSPSSLAVSAGEKVTMSCKSSQSVLYSSNQKNYLAWYQQKPGQSPKLLIYWASTRESGVPDRFTGSGSGTDFTLTISSVQPEDLAVYYCHQYLSSLTFGAGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC* | 522 |
| F846TC.14A2 | QIQLVQSGPELKKPGETVKISCKASGYTFTNYGMNWVKQAPGKGLKWMGWINTYTGEPTYAGDLKGRFAFSLETSASTAYLQINNLKNEDTATYFCVRYTMDYWGQGTSVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG** | 480 | QAVVTQESALTTSPGETVTLTCRSSTGAVTTSNYANWVQEKPDHLFTGLIGGINNRVPGVPARFSGSLIGDKAALTITGAQTEDEAIYFCALWYSNHWVFGGGTKLTVLRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC* | 525 |

Figure 18 cont.

| Antibody name | Heavy chain sequence | SEQ ID NO: | Light chain sequence | SEQ ID NO: |
|---|---|---|---|---|
| F846TC.14E4 | QVTLKESGPGILQPSQTLSLTCSFSGFSLSTSGMGVGWIRQPSGKGLEWLAHIWWDDDKYYNTALKSGLTISKDASKNQVFLKIASMDTADTATYYCARNLYDGSYGYYAMDYWGQGTSVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG** | 481 | DIVMTQAAFSNPVTLGTSASISCRSSKSLLHTNGITFLYWYLQKPGQSPQPLIYQMSNLASGVPDRFSSSGSGTDFTLRISRVEAEDVGVYYCAQNLELPWTFGGGTKLEINRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC* | 526 |
| F846TC.16B5 | QIQLVQSGPELKKPGETVKISCKASGYTFTNYGMNWVKQAPGKGLKWMGWINTYTGEPAYADDFKGRFAFSLETSASTAYLQINNLKNEDMATYFCARWGGYDGDYYAMDYWGQGTSVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG** | 482 | NIMMTQSPSSLAVSAGEKVTMSCKSSQSVLYSSNQKNYLAWYQQKPGQSPKLLIYWASTRESGVPDRFTGSGSGTDFTLTISSVQAEDLAVYYCHQYLSSLTFGAGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC* | 527 |
| F846TC.7F10 | EVQLVESGGDLVKPGGSLKLSCAASGFTFSNYGLSWIRQTPDKRLEWVATISSGGSYTYYPDSVKGRFTISRDSAKNTLYLQMSSLKSEDTAMYYCARHAHYYGVSPYYFDYWGQGTCLTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG** | 483 | DIVMTQSPSSLAMSVGQKVTMSCKSSQSLLNSSNQKNYLAWYQQKPGQSPKLLVYFASTRESGVPDRFIGSGSGTDFTLTISSVQAEDLADYFCQQHYSTPYTFGGGAKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC* | 528 |

Figure 18 cont.

| Antibody name | Heavy chain sequence | SEQ ID NO: | Light chain sequence | SEQ ID NO: |
|---|---|---|---|---|
| F847C.10B9 | QIQLVQSGPEVKKPGETVKISCKASGYIFTNYGMNWVKQAPGKGLKWMGWINTYTGEPTYTDDFKGRFAFSLETSASTAYLQINNLKNEDTATYFCAKFGNYVGAMDYWGQGTSVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG** | 484 | DIRMTQSPSSLSASLGDTITITCHASQNINVWLSWYQQKPGNIPKLLIYKASNLHTGVPSRFSGSGSGTGFTLTISSLQPEDIATYYCQQGQSYPYTFGGGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC* | 529 |
| F847C.11B1 | EVQLQQSGPELVKPGASVKISCKASGNTFTDHNMHWVKQSHGKSLEWIGYIYPYNGGTGYNQKFKSKATLTVDNSSSTVYMELRSLTSEDSAVYYCARGEYDYLAWFAYWGQGTLVTVSAASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG** | 485 | EIVLTQSPASLSVTTGEKVTIRCITSIDIDDDMNWYQQKPGEPPKLLISEGNTLRPGVPSRFSSSGYGTDFVFTIENTLSEDVADYYCLQSDNKPLTFGAGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC* | 530 |
| F847C.12F12 | QIQLVQSGPELKKPGETVKISCKASGYTFTNYGMNWVKQAPGKGLKWMGWINTYTGEPTYVDDFKGRFAFSLETSASTAYLRINNLKNEDTATYFCAKFGNYVGAMDYWGQGTSVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG** | 486 | DIQVIQSPSSLSASLGDTITITCHASQNINVWLSWYQQKPGNIPKLLIYKASNLHTGVPSRFSGSGSGTGFTLTISSLQPEDIATYYCQQGQSYPYTFGGGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC* | 531 |

Figure 18 cont.

| Antibody name | Heavy chain sequence | SEQ ID NO: | Light chain sequence | SEQ ID NO: |
|---|---|---|---|---|
| F847C.26F5 | QIQLVQSGPEVKKPGETVKISCKASGYIFTNYG MNWVKQAPGKGLKWMGWINTYTGEPTYTDDF KGRFAFSLETSASTAYLQINNLKNEDTATYFCA KFGNYVGAMDYWGQGTSVTVSSASTKGPSVFP LAPCSRSTSESTAALGCLVKDYFPEPVTVSWNS GALTSGVHTFPAVLQSSGLYSLSSVVTVPSSSLG TKTYTCNVDHKPSNTKVDKRVESKYGPPCPPCP APEFLGGPSVFLFPPKPKDTLMISRTPEVTCVVV DVSQEDPEVQFNWYVDGVEVHNAKTKPREEQF NSTYRVVSVLTVLHQDWLNGKEYKCKVSNKG LPSSIEKTISKAKGQPREPQVYTLPPSQEEMTKN QVSLTCLVKGFYPSDIAVEWESNGQPENNYKTT PPVLDSDGSFFLYSRLTVDKSRWQEGNVFSCSV MHEALHNHYTQKSLSLSLG** | 487 | EIKMNQSPSSLSASLGDT ITITCHASQNINVWLSW YQQKPGNIPKLLIYKASN LHTGVPSRFSGSGSGTGF TLTISSLQPEDIATYYCQ QGQSYPYTFGGGTKLEL KRTVAAPSVFIFPPSDEQ LKSGTASVVCLLNNFYP REAKVQWKVDNALQSG NSQESVTEQDSKDSTYS LSSTLTLSKADYEKHKV YACEVTHQGLSSPVTKS FNRGEC* | 532 |
| F847C.4B10 | EVQLVETGGGLVKPGGSLKLSCAASGFTFSSYA MSWVRQTPEKRLEWVASISGGSTYYPDSVKG RFTISRDNARNILYLQMSSLRSEDTAMYYCTRF TTVVEMDYWGQGTSVTVSSASTKGPSVFPLAP CSRSTSESTAALGCLVKDYFPEPVTVSWNSGAL TSGVHTFPAVLQSSGLYSLSSVVTVPSSSLGTKT YTCNVDHKPSNTKVDKRVESKYGPPCPPCPAPE FLGGPSVFLFPPKPKDTLMISRTPEVTCVVVDVS QEDPEVQFNWYVDGVEVHNAKTKPREEQFNST YRVVSVLTVLHQDWLNGKEYKCKVSNKGLPSS IEKTISKAKGQPREPQVYTLPPSQEEMTKNQVSL TCLVKGFYPSDIAVEWESNGQPENNYKTTPPVL DSDGSFFLYSRLTVDKSRWQEGNVFSCSVMHE ALHNHYTQKSLSLSLG** | 488 | QAVVTQESALTTSPGET VTLTCRSSTGAVTTSNY ANWVQEKPDHLFTGLIG GTNNRAPGVPARFSGSLI GDKAALTITGAQTEDEA IYFCALWYSNHLVFGGG TKLTVLRTVAAPSVFIFP PSDEQLKSGTASVVCLL NNFYPREAKVQWKVDN ALQSGNSQESVTEQDSK DSTYSLSSTLTLSKADYE KHKVYACEVTHQGLSSP VTKSFNRGEC* | 533 |
| F849C.8D10 | QVQLQQTGAELVKPGASVKLSCKASGYTFTSY WINWVKQRPGQGLEWIGNIYPGSSSIYYSEKFK SKATLTVDTSSSTAYMQLSSLTSDDSAVYYCAR WGYWGQGTTLTVSSASTKGPSVFPLAPCSRSTS ESTAALGCLVKDYFPEPVTVSWNSGALTSGVHT FPAVLQSSGLYSLSSVVTVPSSSLGTKTYTCNVD HKPSNTKVDKRVESKYGPPCPPCPAPEFLGGPS VFLFPPKPKDTLMISRTPEVTCVVVDVSQEDPEV QFNWYVDGVEVHNAKTKPREEQFNSTYRVVSV LTVLHQDWLNGKEYKCKVSNKGLPSSIEKTISK AKGQPREPQVYTLPPSQEEMTKNQVSLTCLVK GFYPSDIAVEWESNGQPENNYKTTPPVLDSDGS FFLYSRLTVDKSRWQEGNVFSCSVMHEALHNH YTQKSLSLSLG** | 489 | DVLMTQTPLSLPVSLGD QASISCRSSQDIVHSSGN TYLEWYLQKPGQSLKLL IYKVSNRFSGVPDRFSAS GSGTDFTLKISRVEAEDL GVYYCFQGSHVPPTFGS GTKLEIKRTVAAPSVFIF PPSDEQLKSGTASVVCL LNNFYPREAKVQWKVD NALQSGNSQESVTEQDS KDSTYSLSSTLTLSKADY EKHKVYACEVTHQGLSS PVTKSFNRGEC* | 534 |

Figure 18 cont.

| Antibody name | Heavy chain sequence | SEQ ID NO: | Light chain sequence | SEQ ID NO: |
|---|---|---|---|---|
| F849C.8H3 | QVTLKESGPGILQPSQTLSLTCSFSGFSLSTFGMGVGWIRQPSGKGLEWLAHIWWDDDKHYNPALKSRLTISKDTSKNQVFLRIANVDTADNATYYCARIDYGDYVGFAYWGQGTLVTVSAASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG** | 490 | DIGMRQAAFSNPVTLGTSASISCRSSKSLLYSNGITYLYWFLQKPGQSPQLLIYQMSNLASGVPDRFSSSGSGTDFTLRISRVEADDVGVYYCAQNLELPWTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC* | 535 |
| 846.2B11 | QVQLQQSGPELVRPGALVKISCKASGYTFTSYDINWVKQRPGQGLEWIGWIYPGDGSTKYNEKFKGKATLTADKSSSTAYMQLSSLTSENSAVYFCAREAASNAMDYWGQGTSVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG** | 491 | DIVLTQSPASLGVSLGQRATISCRASKSVSTSGYSYMHWYQQKPGQPPKLLIYLASILESGVPARFSGSGSGTDFTLNIHPVEEEDAAIYYCQHSRELPLTFGAGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC* | 536 |
| 846.4D5 | EVKLEESGGGLVQPGGSMKLSCVASGFTFSNYWMNWVRQSPEKGLEWVAEIRLKSNNYATHYAESVKGRFTISRDDSKSSVYLQMNNLRAEDTGIYYCTRHYGFPYWYFDVWGAGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG** | 492 | NIVLTQSPASLAVSLGQRATISCRASESVDSYGNSFMHWYQQKPGQPPKLLIYLASNLESGVPARFSGSGSRTDFTLTIDPVEADDAATYYCQQNNEDPWTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC* | 537 |

Figure 18 cont.

| Antibody name | Heavy chain sequence | SEQ ID NO: | Light chain sequence | SEQ ID NO: |
|---|---|---|---|---|
| 846T.1H2 | QIQLVQSGPELKKPGETVKISCKASGYTFTNYGMNWVKQAPGKGLKWMGWINTNTGEPTYAEEFKGRFAFSLETSASTAYLQINNLKNEDTATYFCATGGGNWDFDYWGQGTTLTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG** | 493 | DVVMTQTPLTLSVTIGQPASISCKSSQSLLYSNGKTYLNWLLQRPGQSPKRLIYLVSKLDSGVPDRFTGSGSGTDFTLKISRVEAEDLGVYYCVQGTHFPQTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC* | 538 |
| 847.14H4 | QIQLVQSGPELTKPGETVKISCKASGYTFTDYGMNWVRQAPGETLKWMGWINTYTGEPTYADDFKGRFAFSLESSASTAYLQINNLKNEDVATYFCARYPMDYWGQGTSVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG | 494 | QAVVTQESALTTSPGETVTLTCRSSTGAVTTSNYANWVQEKPDHLFTGLIGGTNNRAPGVPARFSGSGSLIGDKAALTITGAQTEDEAIYFCALWYSNHLVFGGGTKLTVLRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC* | 533 |
| 2D10-VH0-VL0 | QVQLQQSGPELVKPGASVKISCKASGYTFTDYYINWVKQRPGQGLEWIGWIYPGSQDTKYNEKFKGKATLTVDTSSSTAYMQLGSLTSEDSAVYFCANYFGSSGWFFDVWGTGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG-- | 829 | DIVMTQAAFSNPVTLGTSASISCRSSKSLLHSDGITYLYWYLQRPGQSPQLLIYRMSNLASGVPDRFSGSGSGTDFTLRISRVEAEDVGVYYCAQMIEFPLTFGAGTILELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC- | 830 |

Figure 18 cont.

Exemplary hIgG1, Ch2 constant heavy chain domain 2. Fc region (SEQ ID NO: 831):

EPKSCDKTHTCPPCPAPELLGGPSVFLFPPKPKDTLMISRTPEVTCVVVDVSHEDPEVKFNWYV
DGVEVHNAKTKPREEQYNSTYRVVSVLTVLHQDWLNGKEYKCKVSNKALPAPIEKTISKAK

Exemplary hIgG4(S228P) Fc region (SEQ ID NO: 832):

ASTKGPSVFPLAPCSRSTSESTAALGCLVKDYFPEPVTVSWNSGALTSGVHTFPAVLQSSGLYS
LSSVVTVPSSSLGTKTYTCNVDHKPSNTKVDKRVESKYGPPCPPCPAPEFLGGPSVFLFPPKPK
DTLMISRTPEVTCVVVDVSQEDPEVQFNWYVDGVEVHNAKTKPREEQFNSTYRVVSVLTVLH
QDWLNGKEYKCKVSNKGLPSSIEKTISKAKGQPREPQVYTLPPSQEEMTKNQVSLTCLVKGFY
PSDIAVEWESNGQPENNYKTTPPVLDSDGSFFLYSRLTVDKSRWQEGNVFSCSVMHEALHNH
YTQKSLSLSLG

Exemplary hIgG4 kappa chain constant domain (SEQ ID NO: 833):

RTVAAPSVFIFPPSDEQLKSGTASVVCLLNNFYPREAKVQWKVDNALQSGNSQESVTEQDSKD
STYSLSSTLTLSKADYEKHKVYACEVTHQGLSSPVTKSFNRGEC

Exemplary mIgG2A(LALAPG) Fc region (SEQ ID NO: 838):

AKTTPPSVYPLAPVCGDTTGSSVTLGCLVKGYFPEPVTLTWNSGSLSSGVHTFPAVLQSDLYTL
SSSVTVTSSTWPSQSITCNVAHPASSTKVDKKIEPRGPTIKPCPPCKCPAPNAAGGPSVFIFPPKI
KDVLMISLSPIVTCVVVDVSEDDPDVQISWFVNNVEVHTAQTQTHREDYNSTLRVVSALPIQH
QDWMSGKEFKCKVNNKDLGAPIERTISKPKGSVRAPQVYVLPPPEEEMTKKQVTLTCMVTDF
MPEDIYVEWTNNGKTELNYKNTEPVLDSDGSYFMYSKLRVEKKNWVERNSYSCSVVHEGLH
NHHTTKSFSRTPGK

Exemplary mIgG2A(LALA) Fc region (SEQ ID NO: 839):

AKTTPPSVYPLAPVCGDTTGSSVTLGCLVKGYFPEPVTLTWNSGSLSSGVHTFPAVLQSDLYTL
SSSVTVTSSTWPSQSITCNVAHPASSTKVDKKIEPRGPTIKPCPPCKCPAPNAAGGPSVFIFPPKI
KDVLMISLSPIVTCVVVDVSEDDPDVQISWFVNNVEVHTAQTQTHREDYNSTLRVVSALPIQH
QDWMSGKEFKCKVNNKDLPAPIERTISKPKGSVRAPQVYVLPPPEEEMTKKQVTLTCMVTDF
MPEDIYVEWTNNGKTELNYKNTEPVLDSDGSYFMYSKLRVEKKNWVERNSYSCSVVHEGLH
NHHTTKSFSRTPGK

Figure 19 cont.

IMT001 And IMT006 Humanized Gal3 Therapeutic Antibodies
Humanized IMT001 and IMT006, derived from mouse mAbs, both have high affinity for human and cynomolgus galectin-3, whereas IMT001 also has high affinity for mouse galectin-3
|  | Antibody $K_D$ Affinities (nM) | | | |
| --- | --- | --- | --- | --- |
|  | Human | Cynomolgus | Rat | Mouse |
| IMT001 | 3.6 | 8.9 | 14 | 2.3 |
| IMT006 | 8.9 | 5.1 | undetected | 40000 |
IMT001 is highly specific for galectin-3
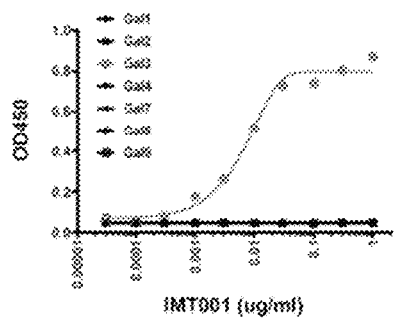
IMT006 is highly specific for galectin-3
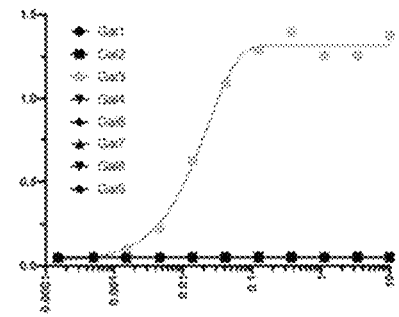
Figure 20

| mTB001 | TB001 | 4A11.H1L1 | TB006 | 4A11.H4L2 |
|---|---|---|---|---|
| Murine IMT001 | IMT001 | IMT006-1 | 4A11.H3L1 | IMT006-8 |
| mIMT001 | IMT001-4 | IMT006b | IMT006-5 | IMT006c |
| | | | IMT006a | |

Antibody names shown in each column refer to the same antibody as provided in the present disclosure and may be used interchangeably

Figure 28

| Antibody | SEQ ID NO: | V_H nucleic acid sequence |
|---|---|---|
| TB001 (IMT001; IMT001-4) | 539 | CAGGTGCAGCTGGTGCAGTCCGGCTCCGAGCTGAAAAAACCCGGCGCCTCCGT GAAAGTGTCCTGCAAAGCCTCCGGCTACACATTCACAAACTACGGCATGAACTG GGTGAGGCAGGCCCCCGGCCAGGGCCTGAAATGGATGGGCTGGATCAACACAA ACACAGGCGAGCCCACATACGTGGAGGAGTTCACAGGCAGGTTCGTGTTCTCCC TGGAGACATCCGTGTCCACAGCCTACCTGCAGATCTCCTCCCTGAAAGCCGAGG ACACAGCCGTGTACTTCTGCGCCCCCTACGACAACTTCTTCGCCTACTGGGGCC AGGGCACAACAGTGACAGTGTCCTCC |
| TB006 (4A11.H3L1; IMT006; IMT006a) | 540 | CAGATTCAATTGGTTCAGAGCGGCTCAGAACTGAAAAAGCCTGGAGCCAGCGT TAAAGTGAGCTGTAAAGCCAGTGGATACACATTCACCACTTACGTCATGTCCTG GGTTAGACAGGCCCCTGGACAGGGGCTGGAATGGATGGGCTGGATAAACACTC ACTCTGGAGTGCCCACATACGCCGACGACTTTACAGGCAGGTTCGTGTTTTCCC TAGATACTAGTGTGAATACTGCATACTTGCAAATCTCTTCTGAAAGCAGAGG ATACCGCCGTGTACTTTTGCACCCGCGATGGGAATGATGGGGATGCCATGGACA ACTGGGGCCAGGGGACGACTGTGACAGTGTCTTCA |
| 12G5.D7 | 541 | CAGGTGCAGCTGAAGCAGTCTGGGGCTGAGCTGGTGAGGCCTGGGGCTTCAGT GAAGCTGTCCTGCAAGGCTTCTGGCTACACTTTCACTGACTACTATATAAACTG GGTGAAGCAGAGGCCTGGACAGGGACTTGAGTGGATTGCAAGGATTTATCCTG GAACTGGTAATACTGACTACAATGAGAAGTTCAAGGGCAGGCCACACTGACT GCAGAAAACTCCTCCAGCACTGCCTACATGCAGCTCAGCAGTCTGACATCTGAG GACTCTGCTGTCTATTTCTGTGCAAGATTTGCGTATTACTACGGTAGTGGAGGGT ACTTTGACTACTGGGGCCACGGCACCACTCTCACAGTCTCCTCA |
| 13A12.2E5 | 542 | CAGATCCAGTTGGTACAGTCTGGACCTGAGCTGAAGAAGCCTGGAGAGACAGT CAAGATCTCCTGCAAGACTTCTGGGTATAAATTCAAAACCTATGTGATGAGCTG GGTGAAACAGGCTCCAGGAAAGGCTTTAAAGTGGATGGGCTGGATAAACACCT ACTCTGGAGTGCCAACATATGCTGATGACTTCAAGGGACGATTTGCCTTCTCTTT GGAAACCTCTGCCAGCACTGCCTATTTGGAGATCATCAACCTCAAAAATGAGGA CACGGCTACATATTTCTGTGCAAGAGATGGTAACTACGGGGATCCTATGGACTA CTGGGGTCAAGGAACCTCAGTCACCGTCTCCTCA |
| 14H10.2C9 | 543 | CAGATCCAGTTGGTACAGTCTGGACCTGAGCTGAAGAAGCCTGGAGAGACAGT CAAGATCTCCTGCAAGGCTTCTGGGTATACCTTCACAACCTATGGAATGGGCTG GGTGAAACAGGCTCCAGGAAAGGATTTAAAGTGGATGGGCTGGATAAACACCT ACTCTGGAGTGCCAACATATGCTGATGACTTCAAGGGACGGTTTGCCTTCTCTTT GGAAACCTCTGCCAGCACTGCCTATTTGCAGATCAGCAACCTCAAAAATGAAG ACACGGCTACATATTTCTGTTCAACCCCTTATGAATACGACGGGGCTTACTGGG GCCAGGGGACTCTGGTCACTGTCTCTGCA |
| 15F10.2D6 | 544 | GAAGTACAGCTGGTGGAGTCTGGGGGAGGCTTAGTGAAGCCTGGAGGGTCCCT GAAACTCTCCTGTGCAGCCTCTGGATTCGCTTTCAGTTCCTATGCCATGTCTTGG GTTCGCCAGACTCCGGAAAAGAGGCTGGAGTGGGTCGCAACCATTAGTGATGG TGGTGTTTACACCTACTATACAGACCATGTAAAGGGCCGATTCACCATCTCCAG AGACAATGCCGAGGACAACCTGTACCTGCAAATGAGCCATCTGAAGTCTGAGG ACACAGCCATGTATTATTGTGTGAGAGATGGGGGCTACTGGGGCCAAGGCACC ACTCTCACAGTCTCCTCA |
| 19B5.2E6 | 545 | CAGATCCAACTTGTTCAGAGCGGGCCTGAATTGAAGAAACCAGGCGAGACTGT AAAGATCTCCTGTAAGGCCAGTGGCTATACATTCACCACCTACGCAATGAGCTG GGTCAAGCAGGCACCCGGAAAGGGTCTGAAGTGGATGGGTTGGATAAATACAT ACTCAGGCGTCCCAACCTACGCTGATGATTTGAAGGGCGCTTTGCCTTTTCTCT TGAAACCTCAGCATCAACCGCCTACTTGCAGATAAATAACCTCAAAAATGAAG ACACCGCTACCTATTTCTGCGCAAGGGGGCCTTATGCTATGGACTACTGGGGCC AGGGCACCTCTGTGACTGTAAGTTCT |

Figure 29

| Antibody | SEQ ID NO: | V_H nucleic acid sequence |
|---|---|---|
| 20D11.2C6 | 546 | GAGGTCCAGCTGCAACAATCTGGACCTGAACTGGTGAAGCCTGGGGCTTCAGT GAAGATATCCTGTAAGGCTTCTGGATACACGTTCACTGACTTCTACATAAACTG GGTGAAGCAGAGCCATGGAAAGAGCCTTGAGTGGATTGGAGATATTAATCCTA AGAATGGTGGTATTAACTACAACCCGAAGTTCAAGATCAAGGCCACATTGACT GTAGACAAGTCCTCCAGCACATCCTACATGGACCTCCGCGGCCTGACATCTGAG GACTCTGCAGTCTATTACTGCACCTCAGGCTACGGATTTCCTTACTGGGGCCAA GGGACTCTGGTCACTGTCTCTGCA |
| 20H5.A3 | 547 | CAGATCCAGTTGGTACAGTCTGGACCTGAGCTGAAGAAGCCTGGAGAGTCAGT CAAGATCTCCTGCAAGGCTTCTGGTTATGCCTTCACAACCTATGGAATGAGCTG GGTGCAACAGGCTCCAGGAAAGGGTTTAAAGTGGATGGGCTGGGTAAACACCT ACTCTGGAGTGCCAACATGTGCTGATGACTTCAAGGGACGGTTTGCCTTCTCTTT GGAAACCTCTGCCAGCACTGCCTATTTGCAGATCAACAACCTCAGAAATGAGG ACACGGCTACATATTTCTGTGCAAGAGGGCCCTATGCTATGGACTACTGGGGTC AAGGAACCTCAGTCACCGTCTCCTCA |
| 23H9.2E4 | 548 | CAGATCCAGTTGGTACAGTCTGGACCTGAGCTGAAGAAGCCTGGAGAGACAGT CAAGATCTCCTGCAAGGCTTCTGGGTATACCTTCACAACCTATGCAATGAGCTG GGTGAAACAGGCTCCAGGAAAGGGTTTAAAGTGGATGGGCTGGATAAACACCT ACTCTGGAGTGCCAACATATGCTGATGACCTCAAGGGACGGTTTGCCTTCTCTT TGGAAACCTCTGCCAGCACTGCCTATTTGCAGATCAACAACCTCAAAAATGAGG ACACGGCTACATATTTCTGTGCAAGAGGGCCCTATGCTATGGACTACTGGGGTC AAGGAACCTCAGTCACCGTCTCCTCA |
| 2D10-VH0-VL0 | 549 | CAAGTACAGCTCCAGCAATCAGGACCTGAACTTGTTAAGCCAGGTGCAAGCGT CAAAATAAGTTGTAAAGCATCAGGTTACACCTTTACAGACTACTATATCAACTG GGTCAAGCAACGGCCTGGTCAGGGACTTGAATGGATAGGTTGGATCTACCCTG GGTCACAAGACACCAAGTACAATGAAAAATTTAAGGGGAAAGCCACTCTGACA GTAGATACTAGCTCAAGTACCGCCTACATGCAGCTCGGCAGCCTCACTTCCGAG GACTCTGCCGTATATTTCTGTGCCAACTACTTCGGGTCTTCTGGGTGGTTCTTTG ATGTGTGGGGAACCGGCACCACCGTAACCGTTTCCTCA |
| 3B11.2G2 | 550 | CAGATCCAGTTGGTACAGTCTGGACCTGAGCTGAAGAAGCCTGGAGAGACAGT CAAGATCTCCTGCAAGACTTCTGGGTATAAATTCAAAACCTATGTAATGAGCTG GGTGAAACAGGCTCCAGGAAAGGCTTTAAAGTGGATGGGCTGGATAAACACCT ACTCTGGAGTGCCAACATATGCTGATGACTTCAAGGGACGGTTTGCCTTCTCTTT GGAAACCTCTGCCAGCACTGCCTATTTGGAGATCATCAACCTCAAAAATGAGGA CACGGCTACATATTTCTGTGCAAGAGATGGTAATTACGGGGATCCTATGGACTA CTGGGGTCAAGGAACCTCAGTCACCGTCTCCTCA |
| 7D8.2D8 | 551 | GAAGTGCAGCTGGTGGAGTCTGGGGGAGGCTTAGTGAAGCCTGGAGGGTCCCT GAAACTCTCCTGTGCAGCCTCTGGATTCACTTTCAGTAGCTATGCCATGTCTTGG GTTCGCCAGACTCCGGAAAAGAGGCTGGAGTGGGTCGCAACCATCAGTGATGG TGGTATTTACACCTACTATCCAGACAATGTAAAGGGCCGATTCACCATTTCCAG AGACAATGCCAAGAACAACCTGTTCCTGCAAATGAGCCATCTGAAGTCTGAGG ATACAGCCATGTATTACTGTGTAAGAGATGGGGGCTACTGGGGCCAAGGCACC ACTCTCACAGTCTCCTCA |
| mTB001 (mIMT001) | 552 | CAGATCCAACTTGTGCAGTCAGGTCCAGAATTGAAGAAGCCTGGTGAGACCGT CAAGATTTCCTGTAAGGCCTCTGGTTATACTTTTACCAACTATGGCATGAATTGG GTCAAGCAGGCACCTGGGAAGGGTTTGAAATGGATGGGTGGATAAATACCAA CACAGGGGAACCAACTTACGTTGAAGAGTTTAAGGGTCGTTTTGCATTCAGTCT TGAGACTTCTGCAAGCACAGCTTACCTCCAAATTAACAATCTCAAAAATGAAGA TACTGCTACATATTTCTGTGCTCCTTATGATAATTTTTTCGCCTACTGGGGACAG GGAACTCTGGTCACCGTCTCAGCA |

Figure 29 cont.

| Antibody | SEQ ID NO: | V_H nucleic acid sequence |
|---|---|---|
| 4A11.2B5 | 553 | CAGGTACAACTTCAGCAGAGCGGTCCAGAACTTGTGAAGCCCGGTGCTAGTGTC AAAATATCTTGCAAAGCAAGTGGTTATTCCTTCACCAACTATTACATACACTGG GTAAAACAACGTCCAGGGCAAGGACTCGAATGGATTGGTTGGATCTACCCCGG CAGCGGCAACACTAACTACAACGAGAAGTTTAAAGGCAAAGCTACTCTCACAG CAGACACTTCTAGCAGTACAACAAATATGCAGTTGTCCTCTCTGACTTCCGAAG ACAGCGCCGTCTATTACTGTTCTACTGCACCCGGAGGTTTTGACGTCTGGGGTTC CGGCACCACAGTTACCGTTAGTTCC |
| 4A11.H1L1 (IMT006b) | 554 | CAGGTGCAGCTGGTGCAATCAGGAGCCGAAGTTAAGAAGCCTGGCGCCAGCGT CAAGGTCTCATGTAAAGCCTCCGGTTACAGTTTCACCAACTACTATATGCACTG GGTTAGGCAAGCACCAGGCCAGGGGCTTGAGTGGATGGGATGGATCTATCCAG GGAGCGGTAACACCAATTACAATGAGAAGTTTCAAGGGCGCGTAACCATGACA GCAGATACCAGTATAAGCACCGCCTATATGGAACTCTCGGTTGAGATCCGAT GATACCGCTGTTTATTACTGCTCTACCGCACCTGGTGGTTTCGACGTTGGGGCC AAGGTACTACAGTGACCGTATCATCA |
| 4A11.H4L2 (IMT006c) | 555 | CAGGTGCAACTGGTCCAGTCTGGGGCCGAGGTCAAAAAGCCTGGAGCCTCCGT CAAAGTGTCATGTAAAGCCTCAGGGTATAGTTTCACCAACTACTATATACATTG GGTCAGACAAGCCCCAGGCCAGCGTCTTGAGTGGATGGGATGGATTTATCCCG GATCAGGGAATACAAACTATAACGAGAAATTTCAAGGCAGAGTTACTCTCACT GCCGATACCTCTGCAAGTACTACCTATATGGAGCTCTCCAGTCTCAGAAGCGAA GACACAGCAGTATATTACTGTAGCACCGCCCCAGGCGGGTTTGACGTGTGGGGC CAAGGCACTACTGTAACCGTTAGCTCA |
| 4G2.2G6 | 556 | CAAATACAGCTCGTGCAGTCTGGTCCCGATTTGAAGAAGCCTGGAGAAACCGT AAAGATAAGCTGTAAGGCTAGTGGTTACACTTTCACAACATACGTTATGTCATG GGTTAAACAGGCTCCTGGAAAAGACCTTAAATGGATGGGATGGATTAACACCC ATAGCGGTGTCCCAACTTACGCTGACGATTTAAGGGACGATTTGACTTTTCTCT CGAAACTTCTGCCAACACAGCTTTTTTGCAGATCAACAATCTCAAGAATGAAGA CACCGCAACCTATTTCTGCACTCGAGATGGGAACGACGGGGATGCAATGGATA ACTGGGGACAAGGCACATCAGTTACCGTGAGCTCT |
| 6B3.2D3 | 557 | CAGGTGCAGCTGAAGCAGTCAGGACCTGGCCTAGTGCAGCCCTCACAGAGCCT GTCCATCACCTGCACAGTCTCTGGTTTCTCATTAACTAGTTATGGTGTACACTGG GTTCGCCAGCCTCCAGGAAAGGGTCTGGAGTGGCTGGGAGTGATATGGAGTGG TGGAAGCACAGACTATAATGCTGCTTTCATATCCAGACTGAGCATCAGTAAGGA CAACTCCAAGAGCCAAGTTTTCTTTAAAATGAACAGTCTGCAAGCTGATGACAC TGCCATATACTACTGTGCCAAAGGGCCTTATGATTACGACTTAGGCTGGTTTGC TTACTGGGGCCAAGGGACTCTGGTCACTGTCTCTGCA |
| 6H6.2D6 | 558 | CAGATCCAGCTGGTGCAGTCCGGCCCCGAGCTGAAGAAGCCCGGCGAGACTGT GAAGATCTCCTGCAAGGCCTCCGGCTACACCTTCACCACCTACGGCATGTCCTG GGTGAAGCAGGCCCCCGGCAAGGGCCTGAAGTGGATGGCCTGGATCAACACCT ACTCCGGCGTGCCCACCTACGCCGACGACTTCAAGGGCAGGTTCGCCTTCTCCC TGGAGACTTCCGCCTCCACCGCCTACCTGCAGATCAACAACCTGACCAACGAGG ACACCGCCACCTACTTCTGCGCCAGGGGCCCCTACGCCATGGACTACTGGGGCC AGGGCACCTCCGTGACCGTGTCCTCC |
| 9H2.2H10 | 559 | CAGGTCCAGCTGCAGCAGCCTGGGGCTGAACTGGTGGGGCCTGGGTCTTCAGTG AAGCTGTCCTGCAAGGCTTCTGGCTACACCTTCACCAACTACTGGATACATTGG GTGAAGCAGAGGCCTCTACAAGGCCTTGAATGGATTGGTAACATTGACCCTTCT GATAGTGAAACTCACTACAATCAAAAGTTCAAGGACAAGGCCACATTGACTGT AGACAAATCCTCCAGCACAGCCTACATGCAACTCAGCAGCCTGACATCTGAGG ACTCTGCGGTCTATTACTGTGCAAGACATGGTTACTACGACTACTGGGGCCAAG GCACCACTCTCACAGTCTCCTCA |

Figure 29 cont.

| Antibody | SEQ ID NO: | V_H nucleic acid sequence |
|---|---|---|
| 13G4.2F8 | 560 | CAGGTCCAGCTGCAGCAGCCTGGGGCTGAGCTGGTAAAGCCTGGGGCTTCAGT GAAGTTGTCCTGCAAGGCTTCTGGCTACACTTTCACCAGCTACTGGATGCACTG GGTGAAGCAGAGGCCTGGACAAGGCCTTGAGTGGATTGGAATGATTCATCCTA ACAGTGGTAGTACTGACTACAATGAGAAGTTCAAGAACAAGGCCACACTGAAT GTAGACAAATCCTCCAGTACAGCCTACATACAACTCAGCAGCCTGACATCTGAG GACTCTGCGGTCTATTACTGTACAAGATGGGGGATTTATTACTACGCGAGGGAC TACTGGGGCCAAGGCACCACTCTCACAGTCTCCTCA |
| 13H12.2F8 | 561 | CAGATCCAGCTGGTCCAATCAGGACCCGAACTGAAAAAACCAGGCGAGACAGT CAAAATCAGCTGTAAGGCCTCAGGCTACACTTTCACAACCTACGGGATGTCATG GGTAAAGCAAGCTCCTGGCAAGGGGCTGAAATGGATGGGTTGGATCAACACAT ACTCTGGAGTGCCCACCTACGCTGACGACTTTAAGGGTAGATTCGCATTTAGCC TGGAAACAAGTGCCAGTACAGCCTACCTCCAGATAAACAACTTGAAAAACGAG GATACCGCAACCTATTTTTGCGCCGTCCCCTACGAGTACGACGGTGCCTATTGG GGTCAGGGTACACTCGTAACAGTTTCCGCC |
| 15G7.2A7 | 562 | GAGGTCCAGCTGCAACAATCTGGACCTGAGCTGGTGAAGCCTGGGGCTTCAGT GAAGATATCCTGTAAGGCTTCTGGATACACGTTCACTGACTACTACATGAACTG GGTGAAGCAGAGCCATGGAAAGAGCCTTGAGTGGATTGGAGATATTAATCCTA ACAATGGTGGTACTAACTACAACCAGAAGTTCAAGGGCAAGGCCACATTGACT GTAGACAAGTCCTCCAGCACAGCCTACATGGAGCTCCGCAGCCTGACATCTGAG GACTCTGCAGTCTATTACTGCACCTCAGGCTACGGGTTTCCTTACTGGGGCCAG GGGACTCTGGTCACTGTCTCTGCA |
| 19D9.2E5 | 563 | CAGATCCAGTTGGTACAGTCTGGACCTGAGCTGAAGAAGCCTGGAGAGACAGT CAAGATCTCCTGCAAGGCTTCTGGATATACCTTCACAACCTATGGAATGGGCTG GGTGAAACAGGCTCCAGGAAAGGGTTTGAAGTGGATGGGCTGGATAAACACCT ACTCTGGCGTGCCAACATATGCTGATGACTTCAAGGGACGGTTTGCCTTCTCTTT GGAAACCTCTACCAGCACTGCCTATTTGCAGATCAACAACCTCAAAAATGAGG ACATGGCTACATATTTCTGTGCAACCCCTTATGAATACGACGGGGCTTACTGGG GCCAAGGGACTCTGGTCACTGTCTCTGCA |
| 23B10.2B12 | 564 | CAGGTCCAGCTGCAGCAGTCTGGACCTGAACTGGTGAAGCCTGGGGATTCTGTG AAGATATCCTGCAAGGCTGCTGGCTACACCTTCAGTGACTATTATATAAACTGG GTGAAGCAGAGGCCTGGACAGGGACTTGAGTGGATTGGATGGATTTATCCTGT AAGCGTTAATACTAAGTACAATGAGAAGTTCAAGGGCAAGGCCACATTGACTG TAGACACATCCTCCAGCACAGCCTACATGCAGCTCAGCAGCCTGACCTCTGAGG ACTCTGGGGTCTATTTCTGTGCCTACCTTGATTATTGGGGCCAAGGGACTCTGGT CACTGTCTCTGCA |
| 24D12.2H9 | 565 | CAGGTGCAGCTGAAGCAGTCAGGACCTGGCCTAGTGCAGCCCTCACAGAGCCT GTCCATCACCTGCACAGTCTCTGGTTTCTCATTAACTAGCTATGGTGTACACTGG GTTCGCCAGGCTCCAGGAAAGGGTCTGGAATGGCTGGGAGTGATATGGAGTGG TGGAAGCACAGACTATAATGCTGCTTTCATGTCCAGACTGAGCATCAGCAAGGA CAACTCCAAGAGCCAAGTTTTCTTTAAAATGAACAGTCTGCAAGCTGATGACAC TGCCATATACTACTGTGCCAAAAGCCCTGATGGTTACGACGTCGCCTGGTTTGG TTACTGGGGCCAAGGGACTCTGGTCACTGTCTCTGCA |
| F846C.1B2 | 566 | CAGATCCAGTTGGTGCAGTCTGGACCTGAGCTGAAGAAGCCTGGAGAGACAGT CAAGATCTCCTGCAAGGCTTCTGGGTATACCTTCACAAACTATGGAATGAATTG GGTGAAGCAGGCTCCAGGAAAGGGTTTAAAGTGGATGGGCTGGATAAACACCT ACACTGGAGAGCCATCATATGCTGATGACTTCAAGGGACGGTTTGCCTTCTCTT TGGAAACCTCTGCCAGCACTGCCTATTTGCAGATCAACAACCTCAAAAATGAGG ACATGGCTACATATTTCTGTGCAAGATGGGGGGGTTACGCTGGGGATTACTATG CTATGGACTTCTGGGGTCAAGGAACCTCAGTCACCGTCTCCTCA |

Figure 29 cont.

| Antibody | SEQ ID NO: | V_H nucleic acid sequence |
|---|---|---|
| F846C.1F5 | 567 | CAGATCCAGTTGGTGCAGTCTGGACCTGAGCTGAAGAAGCCTGGAGAGACAGT CAAGATCTCCTGCAAGGCTTCTGGGTATACCTTCACAAACTATGGAATGAACT GGGTGAAGCAGGCTCCAGGAAAGGGTTTAAAGTGGATGGGCTGGATAAACAC CTACACTGGAGAGCCATCATATGCTGATGACTTCAAGGGACGGTTTGCCTTCTC TTTGGAAACCTCTGCCAGCACTGCCTATTTGCAGATCAACAACCTCAAAAATG AGGACATGGCTACATATTTCTGTGCAAGATGGGGGGGTTACGATGGGGATTAC TATGCTATGGACTACTGGGGTCAAGGAACCTCAGTCACCGTCTCCTCA |
| F846C.1H12 | 568 | CAGATCCAGTTGGTGCAGTCTGGACCTGAGCTGAAGAAGCCTGGAGAGACAGT CAAGATCTCCTGCAAGGCTTCTGGGTATACCTTCACAAACTTTGGAATGAACT GGGTGAAGCAGGCTCCAGGAAAGGGTTTAAAGTGGATGGGCTGGATAAACAC CTACACTGGAGAGCCATCATATGCTGATGACTTCAAGGGACGGTTTGCCTTCTC TTTGGAAACCTCTGCCAGCACTGCCTATTTGCAGATCAACAACCTCAAAAATG AGGACATTGCTACATATTTCTGTGCAAGATGGGGGGGTTACGCTGGGGATTAC TATGCTATGGACTACTGGGGTCAAGGAACCTCAGTCACCGTCTCCTCA |
| F846C.1H5 | 569 | GAGGTCCAGCTGTTGGAGTCTGGGGGAGGCTTAGTGAAGCCTGGAGGGTCCCT GAAACTCTCCTGTGCAGCCTCTGGATTCACTTTCAGCAGCTATGCCATGTCTTG GGTTCGCCAGACTCCAGAGAAGAGGCTGGAGTGGGTCGCATCCATTAGTAGTG GTGGTGACACCTACTATCCAGACAGTGTGAAGGGCCGATTCACCATCTCTAGA GATAATGCCAGGAACATCCTGTACCTGCAAATGAGCAGTCTGAGGTCTGAGGA CACGGCCATGTATTACTGTGCAAGTTATGGTAACTCCCTCTTTGACTACTGGGG CCAAGGCACCACTCTCACAGTCTCCTCA |
| F846C.2H3 | 570 | CAGATCCAGTTGGTGCAGTCTGGACCTGAGCTGAAGAAGCCTGGAGAGACAGT CAAGATCTCCTGCAAGGCTTCTGGGTATACCTTCACAAACTATGGAATGAACT GGGTGAAGCAGGCTCCAGGAAAGGGTTTAAAGTGGATGGGCTGGATAAACAC CTACACTGGAGAGCCATCATATGCTGATGACTTCAAGGGACGGTTTGCCTTCTC TTTGGAAACCTCTGCCAGCACTGCCTATTTGCAGATCAACAACCTCAAAAATG AGGACATGGCTACATATTTCTGTGCAAGATGGGGGGGTTACGATGGGGATTAC TATGCTATGGACTACTGGGGTCAAGGAACCTCAGTCACCGTCTCCTCA |
| F846TC.14A2 | 571 | CAGATCCAGTTGGTGCAGTCTGGACCTGAGCTGAAGAAGCCTGGAGAGACAGT CAAGATCTCCTGCAAGGCTTCTGGGTATACCTTCACAAACTATGGAATGAACT GGGTGAAGCAGGCTCCAGGAAAGGGTTTAAAGTGGATGGGCTGGATAAACAC CTACACTGGAGAGCCAACATATGCTGGTGACCTCAAGGGACGGTTTGCCTTCT CTTTGGAAACCTCTGCCAGCACTGCCTATTTGCAGATCAACAACCTCAAAAAT GAGGACACGGCTACATATTTCTGTGTAAGATATACTATGGACTACTGGGGTCA AGGAACCTCAGTCACCGTCTCCTCA |
| F846TC.14E4 | 572 | CAGGTTACTCTGAAAGAGTCTGGCCCTGGGATATTGCAGCCCTCCCAGACCCT CAGTCTGACTTGTTCTTTCTCTGGGTTTTCACTGAGCACTTCTGGTATGGGTGTA GGCTGGATTCGTCAGCCTTCAGGGAAGGGTCTGGAGTGGCTGGCACACATTTG GTGGGATGATGATAAGTACTATAACACAGCCCTGAAGAGCGGGCTCACAATCT CCAAGGATGCCTCCAAAAACCAGGTCTTCCTCAAGATCGCCAGTATGGACACT GCAGATACTGCCACATACTACTGTGCTCGAAACCTCTATGATGGTTCCTACGG GTACTATGCTATGGACTACTGGGGTCAAGGAACCTCAGTCACCGTCTCCTCA |
| F846TC.16B5 | 573 | CAGATCCAGTTGGTGCAGTCTGGACCTGAGCTGAAGAAGCCTGGAGAGACAGT CAAGATCTCCTGCAAGGCTTCTGGGTATACCTTCACAAACTATGGAATGAACT GGGTGAAGCAGGCTCCAGGAAAGGGTTTAAAGTGGATGGGCTGGATAAACAC CTACACTGGAGAGCCAGCATATGCTGATGACTTCAAGGGACGGTTTGCCTTCT CTTTGGAAACCTCTGCCAGCACTGCCTATTTGCAGATCAACAACCTCAAAAAT GAGGACATGGCTACATATTTCTGTGCAAGATGGGGGGGTTACGATGGGGATTA CTATGCTATGGACTACTGGGGTCAAGGAACCTCAGTCACCGTCTCCTCA |

Figure 29 cont.

| Antibody | SEQ ID NO: | VH nucleic acid sequence |
|---|---|---|
| F846TC.7F10 | 574 | GAAGTGCAGCTGGTGGAGTCTGGGGGAGACTTAGTGAAGCCTGGAGGGTCCCT GAAACTCTCCTGTGCAGCCTCTGGATTCACTTTCAGTAACTATGGCTTGTCTTG GATTCGCCAGACTCCAGACAAGAGGCTGGAGTGGGTCGCAACCATTAGTAGTG GTGGTAGTTACACCTACTATCCTGACAGTGTGAAGGGGCGATTCACCATCTCC AGAGACAGTGCCAAGAACACCCTGTACCTGCAAATGAGCAGTCTGAAGTCTGA GGACACAGCCATGTATTACTGTGCAAGACATGCGCATTACTACGGTGTTAGCC CGTACTACTTTGACTACTGGGGCCAAGGCACCTGTCTCACAGTCTCCTCA |
| F847C.10B9 | 575 | CAGATCCAGTTGGTGCAGTCTGGACCTGAGGTGAAGAAGCCTGGAGAGACAG TCAAGATCTCCTGCAAGGCTTCTGGGTATATCTTCACAAACTATGGAATGAACT GGGTGAAGCAGGCTCCAGGAAAGGGTTTAAAGTGGATGGGCTGGATAAACAC CTACACTGGAGAGCCAACATATACTGATGACTTCAAGGGACGGTTTGCCTTCT CTTTGGAAACCTCTGCCAGCACTGCCTATTTGCAGATCAACAACCTCAAAAAT GAGGACACGGCTACATATTTCTGTGCAAAGTTTGGTAACTACGTGGGAGCTAT GGACTACTGGGGTCAAGGAACCTCAGTCACCGTCTCCTCA |
| F847C.11B1 | 576 | GAGGTCCAGCTTCAGCAGTCTGGACCTGAGCTGGTGAAACCTGGGGCCTCAGT GAAGATATCCTGCAAGGCTTCTGGAAACACATTCACTGACCACAACATGCACT GGGTGAAGCAGAGCCATGGAAAGAGCCTTGAGTGGATTGGATATATTTATCCT TACAATGGTGGTACTGGCTACAACCAGAAGTTCAAGAGCAAGGCCACATTGAC TGTAGACAATTCCTCCAGCACAGTCTACATGGAGCTCCGCAGCCTGACATCTG AGGACTCTGCAGTCTATTACTGTCAAGAGGGGAGTATGATTACCTGGCCTGG TTTGCTTACTGGGGCCAAGGGACTCTGGTCACTGTCTCTGCA |
| F847C.12F12 | 577 | CAGATCCAGTTGGTGCAGTCTGGACCTGAGCTGAAGAAGCCTGGAGAGACAGT CAAGATCTCCTGCAAGGCTTCTGGGTATACCTTCACAAACTATGGAATGAACT GGGTGAAGCAGGCTCCAGGAAAGGGTTTAAAGTGGATGGGCTGGATAAACAC CTACACTGGAGAGCCAACATATGTTGATGACTTCAAGGGACGGTTTGCCTTCT CTTTGGAAACCTCTGCCAGCACTGCCTATTTGCGGATCAACAACCTCAAAAAT GAGGACACGGCTACATATTTCTGTGCAAAGTTTGGTAACTACGTGGGAGCTAT GGACTACTGGGGTCAAGGAACCTCAGTCACCGTCTCCTCA |
| F847C.26F5 | 578 | CAGATCCAGTTGGTGCAGTCTGGACCTGAGGTGAAGAAGCCTGGAGAGACAG TCAAGATCTCCTGCAAGGCTTCTGGGTATATCTTCACAAACTATGGAATGAACT GGGTGAAGCAGGCTCCAGGAAAGGGTTTAAAGTGGATGGGCTGGATAAACAC CTACACTGGAGAGCCAACATATACTGATGACTTCAAGGGACGGTTTGCCTTCT CTTTGGAAACCTCTGCCAGCACTGCCTATTTGCAGATCAACAACCTCAAAAAT GAGGACACGGCTACATATTTCTGTGCAAAGTTTGGTAACTACGTGGGAGCTAT GGACTACTGGGGTCAAGGAACCTCAGTCACCGTCTCCTCA |
| F847C.4B10 | 579 | GAGGTGCAGCTTGTTGAGACTGGGGGAGGCTTAGTGAAGCCTGGAGGGTCCCT GAAACTCTCCTGTGCAGCCTCTGGATTCACTTTCAGTAGCTATGCCATGTCTTG GGTTCGCCAGACTCCAGAGAAGAGGCTGGAGTGGGTCGCATCCATTAGTAGTG GTGGTAGCACCTACTATCCAGACAGTGTGAAGGGCCGATTCACCATCTCCAGA GATAATGCCAGGAACATCCTGTACCTGCAAATGAGCAGTCTGAGGTCTGAGGA CACGGCCATGTATTACTGTACAAGGTTTACTACGGTAGTAGAGATGGACTACT GGGGTCAAGGAACCTCAGTCACCGTCTCCTCA |
| F849C.8D10 | 580 | CAGGTCCAACTGCAGCAGACTGGTGCTGAGCTTGTGAAGCCTGGGGCCTCAGT GAAGCTGTCCTGCAAGGCTTCTGGCTATACTTTCACCAGCTACTGGATAAACTG GGTGAAGCAGAGGCCTGGACAAGGCCTTGAGTGGATTGGAAACATTTATCCTG GTAGTAGTAGTATTTACTACAGTGAGAAGTTCAAGAGTAAGGCCACACTGACT GTAGACACATCCTCCAGCACAGCCTACATGCAGCTCAGCAGCCTGACATCTGA CGACTCTGCGGTCTATTATTGTGCAAGATGGGGCTACTGGGGCCAAGGCACCA CTCTCACAGTCTCCTCA |

Figure 29 cont.

| Antibody | SEQ ID NO: | V$_H$ nucleic acid sequence |
|---|---|---|
| F849C.8H3 | 581 | CAGGTTACTCTGAAAGAGTCTGGCCCTGGGATATTGCAGCCCTCCCAGACCCTC AGTCTGACTTGTTCTTTCTCTGGGTTTTCACTGAGCACTTTTGGTATGGGTGTAG GCTGGATTCGTCAGCCTTCAGGGAAGGGTCTGGAGTGGCTGGCACACATTTGGT GGGATGATGATAAACACTATAACCCAGCCCTGAAGAGCCGGCTCACAATCTCC AAGGATACCTCCAAAAACCAGGTCTTCCTCAGGATCGCCAATGTGGACACTGCA GATAATGCCACATATTACTGTGCTCGAATCGACTATGGTGACTACGTCGGGTTT GCTTATTGGGGCCAAGGGACTCTGGTCACTGTCTCTGCA |
| 846.2B11 | 582 | CAGGTCCAGCTACAGCAGTCTGGACCTGAGCTGGTGAGGCCTGGGGCTTTAGTG AAGATTTCCTGCAAGGCTTCTGGTTACACCTTCACAAGCTACGATATAAACTGG GTGAAGCAGAGGCCTGGACAGGGACTTGAGTGGATTGGATGGATTTATCCTGG AGATGGTAGTACTAAATATAATGAGAAATTCAAGGGCAAGGCCACACTGACTG CAGACAAATCCTCCAGCACAGCCTACATGCAGCTCAGCAGCCTGACTTCTGAGA ACTCTGCAGTCTATTTCTGTGCAAGAGAGGCGGCTTCTAATGCTATGGACTACT GGGGTCAAGGAACCTCAGTCACCGTCTCCTCA |
| 846.4D5 | 583 | GAAGTGAAGCTTGAGGAGTCTGGAGGAGGCTTGGTGCAACCTGGAGGATCCAT GAAACTCTCCTGTGTTGCCTCTGGATTCACTTTCAGTAACTACTGGATGAACTGG GTCCGCCAGTCTCCAGAGAAGGGGCTTGAGTGGGTTGCTGAAATTAGATTGAA ATCTAATAATTATGCAACACATTATGCGGATCTGTGAAAGGGAGGTTCACCAT CTCAAGAGATGATTCCAAAAGTAGTGTCTACCTGCAAATGAACAACTTAAGAG CTGAAGACACTGGCATTTATTACTGTACCAGGCACTACGGCTTTCCCTACTGGT ACTTCGATGTCTGGGGCGCAGGGACCACGGTCACCGTCTCCTCA |
| 846T.1H2 | 584 | CAGATCCAGTTGGTGCAGTCTGGACCTGAGCTGAAGAAGCCTGGAGAGACAGT CAAGATCTCCTGCAAGGCTTCTGGGTATACCTTCACAAACTATGGAATGAACTG GGTGAAGCAGGCTCCAGGAAAGGGTTTAAAGTGGATGGGCTGGATAAACACCA ACACTGGAGAGCCAACATATGCTGAAGAGTTCAAGGGACGGTTTGCCTTCTCTT TGGAAACCTCTGCCAGCACTGCCTATTTGCAGATCAACAACCTCAAAAATGAGG ACACGGCTACATATTTCTGTGCAACCGGGGGGGGTAACTGGGACTTTGACTACT GGGGCCAAGGCACCACTCTCACAGTCTCCTCA |
| 847.14H4 | 585 | CAGATCCAGTTGGTGCAGTCTGGACCTGAACTGACGAAGCCTGGAGAGACAGT CAAGATCTCCTGTAAGGCTTCTGGCTATACCTTCACAGACTATGGAATGAACTG GGTGAGGCAGGCTCCAGGAGAGACTTTAAAGTGGATGGGCTGGATAAACACCT ACACTGGAGAGCCAACATATGCTGATGACTTCAAGGGGCGGTTTGCCTTCTCTT TGGAATCCTCTGCCAGCACTGCCTATTTGCAGATCAACAACCTCAAAAATGAGG ACGTGGCTACATATTTCTGTGCAAGATACCCTATGGACTACTGGGGTCAAGGAA CCTCAGTCACCGTCTCCTCA |
| 846.2D4 | 586 | GAAGTGAAGCTTGAGGAGTCTGGAGGAGGCTTGGTGCAACCTGGAGGATCCAT GAAACTCTCCTGTGTTGCCTCTGGATTCACTTTCAGTAACTACTGGATGAACTGG GTCCGCCAGTCTCCAGAGAAGGGGCTTGAGTGGGTTGCTGAACTTAGATTGAAA TCTAATAATTATGCAACACATTATGCGGAGTCTGTGAAAGGGAGGTTCACCATC TCAAGAGATGATTCCAAAAGTAGTGTCTACCTGCAAATGAACAACTTAAGAGCT GAAGACACTGGCATTTATTACTGTACCAGGCACTACGGCTTTCCCTACTGGTAC TTCGATGTCTGGGGCGCAGGGACCACGGTCACCGTCTCCTCA |
| 846.2F11 | 587 | GAGGTCCAGCTGCAGCAGTCTGGACCTGAGCTGGTGAAGCCTGGGGCTTCAGT GAAGATGTCCTGCAAGGCTTCTGGATACACATTCACTAGCTATGTTATGCACTG GGTGAAGCAGAAGCCTGGGCAGGGCCTTGAGTGGATTGGATATATTAATCCTTA CAATGATGGTACTAAGTACAATGAGAAGTTCAAAGGCAAGGCCACACTGACTT CAGACAAATCCTCCAGCACAGCCTACATGGAGCTCAGCAGCCTGACCTCTGAG GACTCTGCGGTCTATTACTGTGCAAGATTACTTTTTTACTATGCTATGGACTACT GGGGTCAAGGAACCTCAGTCACCGTCTCCTCA |

Figure 29 cont.

| Antibody | SEQ ID NO: | V$_H$ nucleic acid sequence |
|---|---|---|
| 846T.10B1 | 588 | CAGGTTCAGCTGCAGCAGTCTGGACCTGAGCTGGTGAGGCCTGGGGCTTTAGTG AAGATTTCCTGCAAGGCTTCTGGTTACACCTTCACAAGCTACGATATAAACTGG GTGAAGCAGAGGCCTGGACAGGGACTTGAGTGGATTGGATGGATTTATCCTGG AGATGGTAGTACTAAATACAATGAGAAATTCAAGGGCAAGGCCACACTGACTG CAGACAAATCCTCCAGCACAGTTTACATGCAGCTCAGCAGCCTGACTTCTGAGA ACTCTGCAGTCTATTTCTGTGCTAGAGAGGCGGCTTCTAATGCCATGGACTACT GGGGTCAAGGAACCTCAGTCACCGTCTCCTCA |
| 846T.2E3 | 589 | CAGGTCCAGCTGCAGCAGTCTGGACCTGAGCTGGTGAAGCCTGGGGCTTTAGTG AAGATATCCTGCAAGGCTTCTGGTTACACCTTCACAAGCTACGATATAAACTGG GTGAAGCAGAGGCCTGGACAGGGACTTGAGTGGATTGGATGGATTTATCCTGG AGATGGTAGTACTAAGTACAATGAGAAATTCAAGGGCAAGGCCGCACTGACTG CAGACAAGTCCTCCAGCACAGCCTACATGCAGCTCAGCAGCCTGACTTCTGAGA ACTCTGCAGTCTATTTCTGTGCAAGAGAGGCGGCTTCTAATGCTATGGACTACT GGGGTCAAGGAACCTCAGTCACCGTCTCCTCA |
| 846T.4C9 | 590 | GAGGTCCAGCTGCAGCAGTCTGGACCTGAGCTGGTAAAGCCTGGGGCTTCAGT GAAGATGTCCTGCAAGGCTTCTGGATACTCATTCACTAACTATATTATGCACTG GGTGAAGCAGAAGCCTGGGCAGGGCCTTGAGTGGATTGGATATATTAATCCTTA CAATGGTGGTACTAAGTACAATGAGAAGTTCAAAGGCAAGGCCACACTGACTT CAGACAAATCCTCCAGCACAGCCTACATGGAGCTCAGCAGCCTGACCTCTGAG GACTCTGCGGTCTATTACTGTGCAAGATTACTTTTTTACTATGCTATGGACTACT GGGGTCAAGGAACCTCAGTCACCGTCTCCTCA |
| 846T.4E11 | 591 | CAGGTTCAGCTGCAGCAGTCTGGAGCTGAACTGGTAAAGCCTGGGGCTTCAGTG AAGTTGTCCTGCAAGGCTTCTGGCTACACCTTCAGAAGCTATGATATAAACTGG GTGAGGCAGAGGCCTGAACAGGGACTTGAGTGGATTGGATGGATTTTTCCTGG AGAAGGTATTTCTAAGTACAATGAGAAGTTCAAGGGCAAGGCCACACTGACTA CAGACAAATTGTCCAGCACAGCCTACATGCAGCTCAGCAGCCTGACATCTGAG GACTCTGCTGTCTATTTCTGTGCAAGAGAGGCTACGGCTGGGGCTATGGACTAC TGGGGTCAAGGAACCTCAGTCACCGTCTCCTCA |
| 846T.4F5 | 592 | GAGGTGAAGCTTCTCGAGTCTGGAGGAGGCTTGGTGCAACCTGGAGGATCCAT GAAACTCTCCTGTGTTGCCTCTGGATTCACTTTCAGTAACTTCTGGATGAACTGG GTCCGCCAGTCTCCAGAGAAGGGGCTTGAGTGGGTTGCTGAAATTAGATTGAA ATCTAATAATTATGCAACACATTATGCGGAGTCTGTGAAAGGGAGGTTCACCAT CTCAAGAGATGATTCCAAAAGTAGTGTCTACCTGCAAATGAACAACTTAAGAG CTGAAGACACTGGCATTTATTACTGTACCAGGCACTACGGCTTTCCCTACTGGT ACTTCGATGTCTGGGGCGCAGGGACCACGGTCACCGTCTCCTCA |
| 846T.8D1 | 593 | CAGATTCAGTTGCAGCAGTCTGGAGCTGAACTGGTAAAGCCTGGGGCTTCAGTG AAGTTGTCCTGCAAGGCTTCTGGCTACACCTTCACAAGCTATGATATATGCTGG GTGAGGCAGAGGCCTGAGCAGGGACTTGAGTGGATTGGATGGATTTTTCCTGG AGATGGTACTACTAAGTACACTGAGAACTTCAAGGGCAAGGCCACACTGACTA CAGACAAATCCTCCAGCACAGCCTACATGCACCTCAGCAGGCTGACATCTGAG GACTCTGCTGTCTATTTCTGTGCAAGGGAGGGGCGGGCTCCTGGTTTGCTTAC TGGGGCCAAGGGACTCTGGTCACTGTCTCTGCA |
| 847.10C9 | 594 | GAGGTTCAGCTGCAGCAGTCTGGAGCTGAGCTGGTGCGGCCTGGGACTTCAGTG AAGGTGTCCTGCAAGGCTTCGGAATACGCCTTCAATAATTACATGATGGAATGG GTAAAACAGAGGCCTGGACAGGGCCTTGAGTGGATTGGAGTGATTAATCCCGG AAGTGGTGCTACTAATTACAATGAGAATTTCAAGGACAAGGCAACACTGACTG CAGACAAATCCTCCACCACTGCCTACATGCAGCTCAGCAGCCTGACATCTGATG ACTCTGCGGTCTATTTCTGTACCTACAATGATCTTGGTTACTGGGGCCAAGGGA CTCTGGTCACTGTCTCTGCA |

Figure 29 cont.

| Antibody | SEQ ID NO: | V$_H$ nucleic acid sequence |
|---|---|---|
| 847.11D6 | 595 | GAGGTCAAGCTGCAGCAGTCTGGACCTGAGCTGATGAAGCCTGGAACTTCAAT GAAGATATCCTGTAAGGCTTCTGGTTACTCATTCACCGGCTACACCATGAACTG GGTGAAGCAGAGCCATGGAAAGAACCTTGAGTGGATTGGACTTATTAATCCTTA CAATGGTGGTACTAACTACAACCAGAAGTTCAGGGGCAAGGCCACATTAAGTG TAGACAAGTCATCCAACACAGCCTACATGGAGCTCCTCAGTCTGACATCTGAAG ACTCTGCAGTCTATTACTGTGCAAGAAAGGACGATTATTACGGAAGTAGTCCCT ATGCTCTGGACTACTGGGGTCAAGGAACCTCAGTCACCGTCTCCTCA |
| 847.15D12 | 596 | CAGGTCCAGCTGCAGCAGTCTGGAGCTGAGCTGATGAAGCCTGGGGCCTCAGT GAAGATATCCTGCAAGGCTACTGGCTACACATTCACTAACTACTGGATAGAGTG GGTAAAGCAGAGGCCTGGACATGGCCTTGAATGGATTGGAGAATTTTTACCTGG AGATGGCAGTAGTCACTACAATGAAGTTCAAGGGCAAGGCCACATTCACTT CAGATACATCCTCCAACACAGCCTACATACACCTCACCAGCCTGACATCTGAGG ACTCTGCCGTCTATTACTGTGTAAGAGATGACTACGACAGTGACTACTGGGCCC AAGGCACCACTCTCACAGTCTCCTCA |
| 847.15F9 | 597 | CAGGTGCAGATGAAGCAGTCAGGACCTGGCCTAGTGCAGCCCTCACAGAGCCT GTCCATCACCTGCACAGTCTCTGGTTTCTCATTAATCAACTATGGTGTACACTGG GTTCGCCAATCTCCAGGAAAGGGTCTGGAGTGGCTGGGAGTGATATGGAGTGG TGGAAGCACAGACTATAATGCAGCTTTCATATCCAGACTGAGCATCAGCAAGG ACAATTCCAAGAGCCAAGTTTTCTTTAAAATGAACAGTCTGCAAGCTGATGACA CAGCCATATATTACTGTGCCAGAATTTATTACTACGGTAGGGGCTATGCTATGG ACTACTGGGGTCAAGGAACCTCAGTCACCGTCTCCTCA |
| 847.15H11 | 598 | GAGGTCCAGCTTCAGCAGTCTGGGGCTGAAGTTGTGAAGCCTGGGGCTCCAGTG AAGCTGTCCTGCAAGGCTTCTGGCTACACCTTCAACAACTACTGGCTGAACTGG GTGAAACAGCGGCCTGGACGAGGCCTCGAGTGGATTGGAAGGATTGATCCTTC CGATAGTGAAACTCACTACAATCAAAAGTTCAAGGACAAGGCCACACTGACTG TAGACATGTCCTCCAGCACAGCCTACATCCAACTCAGCAGCCTGACATCTGAGG ACTCTGCGGTCTATTACTGTGCAAGAGGGGATTATTATTACGGTACTAGGGGTC CTATGGACTACTGGGGTCAAGGCACCTCAGTCACCGTCTCCTCA |
| 847.20H7 | 599 | CAGGTCCAGCTGCAGCAGTCTGGGGCTGAGCTGGTGAGGCCTGGGGCTTCAGT GAACCTGTCCTGCAAGGCTTCTGGCTACACCTTCACCAACTACTGGATGAACTG GGTGAAGCAGAGGCCTGGACAAGGCCTTGAATGGGTTGGTATGATTGATCCTTC AGACAGTGAAACTCACTACAATCAAATGTTCAAGGACAAGGCCACATTGACTA TAGACAAATCTTCCAGCATAGCCTACATGCAGCTCAGCAGCCTGACATCTGAGG ACTCTGCGGTCTATTACTGTGCAAGATGGGGTGCTATGGACTACTGGGGTCAAG GAACCTCAGTCACCGTCTCCTCA |
| 847.21B11 | 600 | CAGGTGCAACTGAAGCAGTCAGGACCTGGCCTGGTGGCGCCCTCACAGAGCCT GTCCATCACTTGCACTGTCTCTGGATTTTCATTAACCAGCTATGGTGTACACTGG GTTCGCCAGCCTCCAGGAAAGGGTCTGGAGTGGCTGGGAATAATATGGGCTGG TGGAAGCACAAATTATAATCCGGCTCTCATGTCCAGACTGAGCATCAGCAAAG ACAAATCCAAGAGCCAAGTTTTCTTAAAAATGAACAGTCTGAAAACTGATGAC ACAGCCATGTACTACTGTGCCAGAGATCGGGCTTCATTACTACGGCCGGGGGCT ATGGACTACTGGGGTCAAGGAACCTCAGTCACCGTCTCCTCA |
| 847.27B9 | 601 | CAGATCCAGTTGGTGCAGTCTGGACCTGAGCTGAAGAAGCCTGGAGAGACAGT CAAGATCTCCTGCAAGGCTTCTGGGTATACCTTCACAAACTATGGAATGAACTG GGTGAAGCAGGCTCCAGGAAAGGGTTTAAAGTGGATGGGCTGGATAAACACCA ACACTGGAGAGCCAACATATGCTGAAGAGTTCAAGGGACGGTTTGCCTTCTCTT TGGAGACCTCTGCCAGCACTGCCTATTTGCAGATCAACTACCTCAAAAATGAGG ACACGGCTACATTTTTCTGTGCAAGATTGGACTATGATTACGACGAGGACTACT GGGGCCAAGGCACCACTCTCACAGTCTCCTCA |

Figure 29 cont.

| Antibody | SEQ ID NO: | V$_H$ nucleic acid sequence |
|---|---|---|
| 847.28D1 | 602 | CAGGTGCAGCTTGTAGAGACCGGACCTGGCCTGGTGGCGCCCTCACAGAGCCT GTCCATCACTTGCACTGTCTCTGGGTTTTCATTAACCAGCTATGGTGTACACTGG ATTCGTCAGTCTCCAGGAAAGGGTCTGGAGTGGCTGGGAACTATATGGGCTGGT GGAAGCACAGATTATAATTCGCCACTCATGTCCAGACTGAGCATCAGCAAAGA CAACTCCAAGAACCAAGTTTTTTTAAAAATGAATAGTCTGCAGATTGATGACAC AGCCATATATTATTGTGCCAGTCCTCCTTCTGGGTATGATTACGACGTGTTTGCT TCCTGGGGCCAAGGGACTCTGGTCACTGTCTCTGCA |
| 847.2B8 | 603 | CAGGTACAACTGAAGCAGTCAGGACCTGGCCTAGTGCAGCCCTCACAGAGCCT GTCCATCACCTGCACAGTCTCTGGTTTCTCATTAATCAACTATGGTGTACACTGG GTTCGCCAATCTCCAGGAAAGGGTCTGGAGTGGCTGGGAGTGATATGGAGTGG TGGAAGCACAGACTATAATGCAGCTTTCATATCCAGACTGAGCATCAGCAAGG ACAATTCCAAGAGCCAAGTTTTCTTTAAAATGAACAGTCTGCAAGCTGATGACA CAGCCATATATTACTGTGCCAGAATTTATTACTACGGTAGGGGCTATGCTATGG ACTACTGGGGTCAAGGAACCTCAGTCACCGTCTCCTCA |
| 847.3B3 | 604 | CAGGTGCAGCTGAAGGAGTCAGGACCTGGCCTGGTGGCGCCCTCACAGAGCCT GTCCATCACTTGCACTGTCTCTGGGTTTTCATTAACCAGCTATGGTGTACACTGG ATTCGCCAGCCTCCAGGAAAGGGTCTGGAGTGGCTGGGAGGAATATGGGCTGG TGGAAGTACAGATTACAATTCGCCTCTCATGTCCCGACTGAGTATCACTAAAGA CAACTCCAAGAGCCAAGTTTTCTTAAAAATGAACAGTCTGCAAAGTGATGACAC AGCCATGTACTACTGTGCCAGTCCTCCCTCTGGGTATGATTACGACGTGTTTGCT TACTGGGGCCAAGGGACTCTGGTCACTGTCTCTGCA |
| 849.1D2 | 605 | CAGGTGCAGCTGAAGGAGTCAGGACCTGTCCTGGTGGCGCCCTCACAGAGCCT GTCCATCACTTGCACTGTCTCTGGGTTTTCATTAAGCAGCTATGGTGTACACTGG GTTCGCCAGCCTCCAGGAAAGGGTCTGGAGTGGCTGGGAGTAATATGGGCTGG TGGAAGCACAGATTATGATTCAGCTCTCATGTCCAGACTGAGCATCAGCAAAGA CAACTCCAAGAGCCAAGTTTTCTTAAAAATGGACAGTCTGCAAACTGATGACAC AGCCATGTACTACTGTGCCAAACCCCCATATGATTACGACGGGGCCTGGTTTGC TTACTGGGGCCAAGGGACTCTGGTCACTGTCTCTGCA |
| 849.2D7 | 606 | CAGGTGCAACTGCAGCAGTCTGGGCCTCAGCTGGTTAGGCCTGGGGCTTCAGTG AAGATATCCTGCAAGGCTTCTGGTTACTCATTCACCAACTACTGGATGCACTGG GTGAAGCAGAGGCCTGGACAAGGTCTTGAGTGGATTGGCATGATTGATCCTTCC GATAGTGAAACTAGGTTAAATCAGAAGTTCAAGGACAAGGCCACATTGACTGT AGACAAATCCTCCAGCACAGCCTACATGCAACTCAGCAGCCCGACATCTGAGG ACTCTGCGGTCTATTACTGTGCAACGGGGAGACCCGACTACTGGGGCCAAGGC ACCACTCTCACAGTCTCCTCA |
| 849.2F12 | 607 | CAGGTGCAACTGCAGCAGTCTGGGCCTCAGCTGGTTAGGCCTGGGGCTTCAGTG AAGATATCCTGCAAGGCTTCTGGTTACTCATTCACCAGCTACTGGATGCACTGG GTGAAGCAGAGGCCTGGACAAGGTCTTGAGTGGATTGGCATGATTGATCCTTCC GATAGTGAAACTAGGTTAAATCAGAAGTTCAAGGACAAGGCCACATTGACTGT AGACAAATCCTCCAGCACAGCCTACATGCAACTCAGCAGCCCGACATCTGAGG ACTCTATAGTCTATTACTGTGCAAAGGGGAGACCCGACTACTGGGGCCAAGGC ACCACTCTCACAGTCTCCTCA |
| 849.4B2 | 608 | GATGGAAAACTTCAGGAGTCAGGACCTGGCCTCGTGAAACCTTCTCAGTCTCTG TCTCTCACCTGCTCTGTCACTGGCTACTCCATCACCAGTGGTTATTACTGGAACT GGATCCGGCAGTTTCCAGGAAACAAACTGGAATGGATGGGCCACATAAGCTAC GATGGTAGAAATAACTACAACCCATCTCTCAAAAATCGAATCTCCATCACTCGT GACACATCTAAGAACCAGTTTTTCCTGAAGTTGAATTCTGTGACTACTGAGGAC ACAGCCACATATTACTGTGCAGGCTATGATTTCCTCTGGTACTTCGATGTCTGGG GCACAGGGACCACGGTCACCGTCTCCTCA |

Figure 29 cont.

| Antibody | SEQ ID NO: | V_H nucleic acid sequence |
|---|---|---|
| 849.4F12 | 609 | CAGGTGCAGCTGAAGGAGTCTGGCCCTGGGATATTGCAGCCCTCCCAGACCCTC AGTCTGACTTGTTCTTTCTCTGGGTTTTCACTGAGCACTTTTGGTATGGGTGTAG GCTGGATTCGTCAGCCTTCAGGGAAGGGTCTGGAGTGGCTGGCACACATTTGGT GGGATGATGATAAACACTATAACCCAGCCCTGAAGAGCCGGCTCACAATCTCC AAGGATACCTCCAAAAACCAGGTCTTCCTCAGGATCGCCAATGTGGACACTGCA GATAATGCCACATATTACTGTGCTCGAATCGACTATGGTGACTACGTCGGGTTT GCTTATTGGGGCCAAGGGACTCTGGTCACTGTCTCTGCA |
| 849.4F2 | 610 | GATGGACAGCTTCAGGAGTCAGGACCTGGCCTCGTGAAACCTTCTCAGTCTCTG TCTCTCACCTGCTCTGTCACTGGCTACTCCATCACCAGTGGTTATTACTGGAACT GGATCCGGCAGTTTCCAGGAAACAAACTGGAATGGATGGGCCACATAAGCTAC GATGGTAGAAATAACTACAACCCATCTCTCAAAAATCGAATCTCCATCACTCGT GACACATCTAAGAACCAGTTTTTCCTGAAGTTGAATTCTGTGACTACTGAGGAC ACAGCCACATATTACTGTGCAGGCTATGATTTCCTCTGGTACTTCGATGTCTGGG GCACAGGGACCACGGTCACCGTCTCCTCA |
| 849.5C2 | 611 | GAGGTTCAGCTGCAGCAGTCTGGGGCAGAGCTTGTGAAGTCAGGGGCCTCAGT CAAGTTGTCCTGCACAGCTTCTGGCTTCAACATTAAAGACTACTATATGCACTG GGTGAAGCAGAGGACTGAACAGGGCCTGGAGTGGATTGGAAGGATTTATCCTG AGGATGATGAAACTAAATATGCCCCGAAATTCCAGGGCAAGGCCACTATAACA GCAGACACATCTCCAACACAGCCTACCTGCAGCTCAGCAGCCTGACATCTGAG GACACTGCCGTCTATTACTGTGCTAGATCAGGGGGTTACTACGTTTGGTTTGCTT ACTGGGGCCAAGGGACTCTGGTCACTGTCTCTGCA |
| 849.8D12 | 612 | GAGGTCCAGCTACAACAGTCTGGACCTGAGCTGGTGAAGCCTGGGTCTTCAGTG AAGATATCCTGCAAGGCTTCTAGATACACATTCACTGACTACAACATGGACTGG GTGAAGCAGAGCCATGGAAAGAGACTTGAGTGGATTGGATATATTTATCCTAA CAATGGTGGTACTGGCTACAACCAGAAGTTCAAGGGCAAGGCCACATTGACTG TAGACAAGTCCTCCAGCACAGCCTACATGGAGCTCCGCAGCCTGACATCTGAGG ACTCTGCAGTCTATTACTGTGCAAGGTCCTACTACGATGGTAGCTACGATGCTA TGGACTACTGGGGTCAAGGAACCTCAGTCACCGTCTCCTCA |
| F847C.21H6 | 613 | CAGATCCAGTTGGTGCAGTCTGGACCTGAGCTGAAGAAGCCTGGAGAGACAGT CAAGATCTCCTGCAAGGCTTCTGGGTATACCTTCACAATCTTTGGAATGAACTG GGTGAAGCAGGCTCCAGGAAAGGGTTTAAAGTGGATGGGCTGGGTAAACACCT ACACTGGAGAGCCAACATATGCTGATGACTTCAAGGGACGGTTTGCCTTCTCTT TGGAAACCTCTGCCAGCACTGCCTATTTGCAGATCAACAACCTCAAAAATGAGG ACACGGCTACATATTTCTGTGCAAGAGGCTGGTTTGCTTACTGGGGCCAAGGGA CTCTGGTCACTGTCTCTGCA |
| 849.5H1 | 614 | CAGGTGCAGCTGAAGGAGTCAGGACCTGTCCTGGTGGCGCCCTCACAGAGCCT GTCCATCACTTGCACTGTCTCTGGGTTTTCATTAACCAGTTATGGTATACACTGG GTTCGCCAGCCTCCAGGAAAGGGTCTGGAGTGGCTGGGAGTAATATGGGCTGG TGGAAGCACAAATTATAATTCAGCTCTCATGTCCAGACTGAGCATCAGCAAAGA CAACTCCAAGAGCCAAGTTTTCTTAAAAATGAACAGTCTGCAAATTGATGACAC AGCCATGTACTATTGTGCCAAACCCCCCATGATTACGACCAGGCCTGGTTTGC TTACTGGGGCCAAGGGACTCTGATCACTGTCTCTGCA |
| 847.23F11 | 615 | CAGGTCCAGCTGCAGCAGTCTGGGGCTGAGCTGGTGAGGCCTGGGGCTTCAGT GAAGCTGTCCTGCAAGGCTTCTGGCTACACCTTCACCAGCTCCTGGATGAACTG GGTGAAACAGAGGCCTGGACAAGGCCTTGACTGGATTGGTATGATTGATCCTTC AGACAGTGAAACTCACTACAATCAAATGTTCAAGGACAAGGCCACATTGACTG TAGACAAATCCTCTAACACAGCCTACATGCAGCTCAGCAGGCTGACATCTGAGG ACTCAGCGGTCTATTACTGTGTAAATAGTAACTACGAGAGTGGCTATTGGGGCC AAGGCACCACTCTCACAGTCTCCTCA |

Figure 29 cont.

| Antibody | SEQ ID NO: | V_H nucleic acid sequence |
|---|---|---|
| 847.16D10 | 616 | CAGGTCCAGCTGCAGCAGTCTGGGGCTGAGCTGGTGAGGCCTGGGGCTTCAGT GAAGCTGTCCTGCAAGGCTTCTGGCTACACCTTCACCGGCTACTGGTTGAACTG GGTGAAGCAGAGGCCTGGACAAGGCCTGGAATGGATTGGTATGATTGATCCTT CAGACAGTGAAACTCACTACAATCAAGTGTTCAAGGACAAGGCCACAATGACT GTAGACAGGTCCTCCAGCACAGCCTACATGCAGCTCAGCGGACTGACATCTGA GGACTCTGCGGTCTATTACTGTGCAAATAGTAACTACGCGAGTGGCTCCTGGGG CCAGGGCACCACTCTCACAGTCTCCTCA |
| 847.13E2-mH0mL1 | 617 | GAGGTCCAGCTTCAGCAGTCTGGACCTGAGCTGGTGAAGCCTGGGGCTTCAGTG AAGGTTTCCTGCAAGGCTTCTGGTTACTCATTCACTGACTACAACATGTACTGG GTGATGCAGAGCCATGGAAAGAGCCTTGAGTGGATTGGATATATTGATCCTTAC AATGATGCTACTAGCTACAGCCAGAAGTTCACGGGCAAGGCCACATTGACTGTT GACAAGTCCTCCAGCACAGCCTTCATGCATCTCAACAGCCTGACATCTGAGGAC TCTGCAGTCTATTACTGTGCAAGATGGGGGAGGTACGAATACTATGCTATGGAC TATTGGGGTCAAGGAACCTCAGTCACCGTCTCCTCA |
| 847.13E2-mH0mL2 | 618 | GAGGTCCAGCTTCAGCAGTCTGGACCTGAGCTGGTGAAGCCTGGGGCTTCAGTG AAGGTTTCCTGCAAGGCTTCTGGTTACTCATTCACTGACTACAACATGTACTGG GTGATGCAGAGCCATGGAAAGAGCCTTGAGTGGATTGGATATATTGATCCTTAC AATGATGCTACTAGCTACAGCCAGAAGTTCACGGGCAAGGCCACATTGACTGTT GACAAGTCCTCCAGCACAGCCTTCATGCATCTCAACAGCCTGACATCTGAGGAC TCTGCAGTCTATTACTGTGCAAGATGGGGGAGGTACGAATACTATGCTATGGAC TATTGGGGTCAAGGAACCTCAGTCACCGTCTCCTCA |
| 847.12C4 | 619 | CAGGTACAGCTGAAGGAGTCAGGACCTGACCTTGTGCAGCCCTCACAGACCCT GTCTCTCACCTGCACTGTCTCTGGGTTCTCATTAACCATCTATGGTGTTCACTGG GTTCGCCAGCCTCCAGGAAAGGGACTGGAGTGGGTGGGAACAGTGGCCTGGGA TGACAAAAAATATTATAATTCACCTCTACAATCTCGACTGAGCATCAGCAGGGA TACCTCCAAGAACCAAGTTTTCTTAAAACTGAGCAGTCTGCAAACTGAAGACAC AGCCATGTACTACTGTACTATGACTGGGGGCCCTATAAACTACTGGGGTCCAGG AACCTCAGTCACCGTCTCCTCA |
| 847.4D3 | 620 | GAGGTGCAGCTGGTGGAGTCTGGGGGAGGCTTAGTGAAGCCTGGAGGGTCCCT GAAACTCTCCTGTGCAGCCTCTGGATTCACTTTCAGTAGCTATGCCATGTCTTGG GTTCGCCAGACTCCAGAGAAGAGGCTGGAGTGGGTCGCATCCATTAGTAGTGG TGATAGCCCCTACTATCCAGACAGTGTGAAGGGCCGCTTCACCATCTCCAGAGA TAATGCCAGGAACATCCTGTACCTGCAAATGAGCAGTCTGAGGTCTGAGGACA CGGCCATGTATTACTGTACAAGGTTTACTACGGTAGTAGAGATGGACTACTGGG GTCAAGGAACCTCAGTCACCGTCTCCTCA |
| 2D10.2B2 (murine; mIgG2A (LALAPG)) | 834 | CAGGTCCAGCTGCAGCAGTCTGGACCTGAGCTGGTGAAGCCTGGGGCTTCAGTG AAGATATCCTGCAAGGCTTCTGGCTACACCTTCACTGACTACTATATAAACTGG GTGAAGCAGAGGCCTGGACAGGGACTTGAGTGGATTGGATGGATTTATCCTGG AAGCAATGATACCAAGTACAATGAAGTTCAAGGGCAAGGCCACATTGACTG TAGACACATCCTCCAGCACGGCCTACATGCAGCTCGGCAGCCTGACCTCTGAGG ACTCTGCGGTCTATTTCTGTGCGAATTACTTCGGTTGTAGCGGTGGTTCTTCGA TGTCTGGGGCACAGGGACCACAGTCACCGTCTCCTCA |

Figure 29 cont.

| Antibody | SEQ ID NO: | V_L nucleic acid sequence |
|---|---|---|
| TB001 (IMT001; IMT001-4) | 621 | GACATCGTGCTGACCCAGTCTCCACTGAGCCTGCCTGTTACACCTGGCGAGCCAG CCTCCATCTCCTGCAGATCCTCTAAGTCCCTGCTGTACAAGGACGGCAAGACCTAC CTGAACTGGTTCCTGCAGAAGCCCGGCCAGTCTCCTCAGCTCCTGATCTACCTGAT GAGCACCCATGCCTCTGGCGTGCCCGATAGATTTTCCGGCTCTGGCTCTGGCACCG ACTTCACCCTGAAGATCTCCAGAGTGGAAGCCGAGGACGTGGGCGTGTACTACTG TCAGCAGCTGGTGGACTACCCTCTGACCTTTGGCGGCGGAACAAAGCTGGAAATC AAG |
| TB006 (4A11.H3L1; IMT006; IMT006a) | 622 | GATATAGTGATGACCCAAACACCTTTGTCCCTGTCAGTCACCCCAGGCCAACCCG CATCTATCTCATGCAAATCCTCAAAAAGTCTTTTGCACTCTGACGGGATAACATAT CTCTACTGGTATCTTCAAAAACCTGGTCAGTCCCCCCAGCTCTTGATCTATAGAAT GAGTAACCTTGCCTCTGGTGTCCCCGACCGGTTTAGTGGAAGCGGGTCTGGGACC GACTTCACCCTCAAGATTAGTCGCGTCGAAGCCGAAGATGTGGGAGTGTATTACT GTGCCCAGATGCTCGAATTTCCCCTGACATTTGGTCAAGGAACTAAATTGGAGAT TAAG |
| 12G5.D7 | 623 | GACATCCTGATGACCCAATCTCCATCCTCCATGTCTGTATCTCTGGGAGACACAGT CAGCATCACTTGCCATGCAAGTCAGGGCATTAACTCTAATATGGGGTGGTTGCAG CAGAAACCAGGGAAATCATTTAAGGGCCTGATCTATCATGCAACCAACTTGGAAG ATGGAGTTCCATCAAGGTTCAGTGGCAGTGGATCTGGAGCAGATTATTCTCTCAC CATCAGCAGCCTGGAATCTGAAGATTTTGCAGACTATTACTGTGTACAGTATGCTC AGTTTCCTCCTACGTTCGGATCGGGGACCAAGCTGGAAATAAAA |
| 13A12.2E5 | 624 | GATGTTGTGATGACCCAGACTCCACTCACTTTGTCGGTTGCCATTGGACAACCAGC TTCCATCTCTTGCAAGTCGAGTCAGAGCCTCTTATATACTAATGGAAAAACCTATT TGAATTGGTTATTACAGAGGCCAGGCCAGTCTCCAAAACGCCTAATCTATCTGCT GTCTAAATTGGACTCTGGAGTCCCTGACAGGTTCAGTGCCAGTGGATCAGGGACA GATTTCACACTGAAAATCAGCAGAGTGGAGGCTGAGGATTTGGGAGTTTATTACT GCTTGCAGAGTACACATTTTCCGCTCACGTTCGGTGCTGGGACCAAGCTGGAGAT GAAA |
| 14H10.2C9 | 625 | GATGTTGTGATGACCCAGACTCCACTCACTTTGTCGGTTACCATTGGACAACCAGC CTCCATCTCTTGCAAGTCAAGTCAGAGCCTCTTCGATAGTGATGGAAAGACATATT TGAATTGGTTGTTACAGAGGCCAGGCCAGTCTCCAAAGCGCCTAATCTATCTGGT GTCTAAACTGGACTCTGGAGTCCCTGACAGGTTCACTGGCAGTGGATCAGGGACA GATTTCACACTGAAAATCAGCAGAGTGGAGGCTGAGGATTTGGGAGTTTATTATT GCTGGCAAGGTACACATTTTCCTCTCACGTTCGGTGCTGGGACCAAGCTGGAAAT GAAA |
| 15F10.2D6 | 626 | GATGTTTTGATGACCCAAACTCCACTCTCCCTGCCTGTCAGTCTTGGAGATCAAGC CTCCATCTCTTGCAGATCTAGTCAGAGCATTGTACATAATAATGGAAACACCTATT TAGAATGGTACCTGCAGAAACCAGGCCAGTCTCCAAAACTCCTGATCTACAAAGT TTCCAACCGATTTTCTGGGGTCCCAGACAGGTTCAGTGGCAGTGGATCAGGGACA GATTTCACACTCAAGATCAGCAGAGTGGAGGCTGAGGATCTGGGAGTTTATTACT GCTTTCAAGGTTCACATGTTCCGCTCACGTTCGGTGGTGGGACCAAGTTGGAGCTG AAA |
| 19B5.2E6 | 627 | GATATACAAATGACTCAAACTACCTCTTCTCTTTCCGCATCTTTGGGTGATCGGGT CACTATATCCTGCTCCGCCTCTCAAGGCATAAACAATTACCTGAATTGGTATCAGC AAAAACCAGACGGAACTGTAAAATTGCTTATCTACTACGCTTCAAGTCTGCATAG TGGGGTTCCCAGCAGATTTTCCGGTTCCGGGTCCGGCACTGATTATTCTCTCACAA TTAGTAACCTGGAACCTGAGGACATTGCAACTTATTACTGTCAACAATACAGTCA GGTACCTTACACTTTCGGATCAGGAACAAAGTTGGAAATCAAG |

Figure 30

| Antibody | SEQ ID NO: | V_L nucleic acid sequence |
|---|---|---|
| 20D11.2C6 | 628 | GACATCCAGATGAACCAGTCTCCATCCAGTCTGTCTGCATCCCTCGGAGACACAATTACCATCACTTGCCGTGCCAGTCAGAACATTTATATTTGGTTAAGTTGGTACCAGCAGAAACCAGGAAATATTCCTAAACTCTTGATCTATAAGGCTTCCAACTTGCACACAGGCGTCCCATCAAGGTTTAGTGGCAGTGGATCTGGAACAGATTTCACATTAACCATCAGCACTCTGCAGCCTGAAGACATTGCCACTTACTTCTGTCTCCAGGGTCAAAGTTATCCTCTCACGTTCGGTGCTGGGACCAAGCTGGAGATGAAA |
| 20H5.A3 | 629 | GATATCCAGATGACACAGACTACATCCTCCCTGTCTGCCTCTCTGGGAGACAGAGTCACCATCAATTGCAGTGCAAGTCAGGACATTAGCAATTATTTAAACTGGTATCAGCAGAAACCAGATGGAACTGTTAAACTCCTGATCTATTACACATCAAGTTTACTCTCAGGAGTCCCATCAAGGTTCAGTGGCAGTGGGTCTGGGACAGATTATTCTCTCACCATCAGCAACCTGGAACCTGAAGATATTGCCACTTACTTTTGTCAGCAATATAGTAAGCTTCCCTATACGTTCGGATCGGGGACCCACCTGGAAATAAAA |
| 23H9.2E4 | 630 | GATATCCAGATGACACAGACTACATCCTCCCTGTCTGCCTCTCTGGGAGACAGAGTCACCATCAGTTGCAGTGCAAGTCAGGGCATTAACAATTATTTAAACTGGTATCAGCAGAAACCAGATGGAACTGTTAAACTCCTGATCTATTACGCATCAAGTTTACACTCAGGAGTCCCATCAAGGTTCAGTGGCAGTGGGTCTGGGACAGATTATTCTCTCACCATCAGCAACCTGGAACCTGAAGATATTGCCACTTACTATTGTCAGCAGTATAGTCAGGTTCCGTATACGTTCGGATCGGGGACCAAGTTGGAAATAAAA |
| 2D10-VH0-VL0 | 631 | GACATAGTAATGACACAGGCCGCATTTAGCAATCCAGTAACCTTGGGCACATCCGCCTCCATATCTTGCAGGTCATCCAAAAGCTTGCTGCACTCTGACGGTATTACTTACCTGTACTGGTATTTGCAGCGACCTGGGCAATCCCCTCAACTCCTGATTTACCGCATGAGCAACCTGGCCTCAGGGGTGCCTGACCGCTTTTCAGGATCAGGGAGCGGCACTGACTTCACCTTGCGAATCAGCAGAGTAGAAGCAGAGGATGTTGGAGTTTACTACTGTGCCCAGATGATCGAATTTCCACTTACTTTTGGGGCCGGGACCATTCTGGAGCTTAAA |
| 3B11.2G2 | 632 | GATGTTGTGATGACCCAGACTCCACTCACTTTGTCGGTTGCCATTGGACAACCAGCTTCCATCTCTTGCAAGTCGAGTCAGAGCCTCTTATATACTAATGGAAAAACCTATTTGAATTGGTTATTACAGAGGCCAGGCCAGTCTCCAAAACGCCTAATCTATCTGGTGTCTAAATTGGACTCTGGAGTCCCTGACAGGTTCAGTGGCAGTGGATCAGGGACAGATTTCACACTGAAAATCAGCAGAGTGGAGGCTGAGGATTTGGGAGTTTATTACTGCTTGCAGAGTACACATTTTCCGCTCACGTTCGGTGCTGGGACCAAGCTGGAGCTGAAA |
| 7D8.2D8 | 633 | GATGTTTTGATGACCCAAACTCCACTCTCCCTGCCTGTCAGTCTTGGAGATCAAGCCTCCATCTCTTGCAGATCTAGTCAGAGCATTGTACATAGTAATGGAAACACCTATTTAGAATGGTACCTGCAGAAACCAGGCCAGTCTCCAAAGCTCCTGATCTACAAAGTTTCCAACCGATTTTCTGGGGTCCCAGACAGGTTCAGTGGCAGTGGATCAGGGACAGATTTCACACTCAAGATCAGCAGAGTGGAGGCTGAGGATCTGGGAGTTTATTACTGCTTTCAAGGTTCACATGTTCCGCTCACGTTCGGTGCTGGGACCAAGCTGGAGCTGAAA |
| mTB001 (mIMT001) | 634 | GATATTGTTATTACTCAGGATGAGCTTAGTAATCCTGTCACTAGCGGGGAAAGTGTTAGTATCAGTTGTCGTTCATCCAAGTCACTCCTCTACAAAGACGGCAAGACTTATCTCAACTGGTTTCTTAACGACCCGGTCAATCTCCACAGCTCCTGATTTACCTGATGTCAACTCACGCTTCTGGTGTTAGCGACCGTTTCTCCGGAAGTGGCTCCGGGACAGACTTCACTCTTGAAATCTCACGTGTAAAAGCAGAGGACGTAGGTGTCTATTATTGTCAACAGCTTGTGGACTACCCCTTGACCTTTGGCGCTGGCACAAAGCTGGAACTGAAG |

Figure 30 cont.

| Antibody | SEQ ID NO: | V_L nucleic acid sequence |
|---|---|---|
| 4A11.2B5 | 635 | GACATTGTGATGACTCAGGCAGCCTTTTCCAACCCTGTAACACTTGGAACTAGTGCCTCCATCTCATGCCGTTCCAGCAAGAGTCTTTTGCACAGCGATGGGATAACCTATCTCTATTGGTATCTGCAACGACCCGGTCAGTCACCCCAACTTCTTATCTATCGAATGTCTAACTTGGCCTCCGGCGTGCCCGACCGCTTTTCCGGGAGTGGGAGCGGTACAGATTTCACCTTGCGAATTTCCCGGGTTGAGGCAGAGGACGTAGGTGTCTACTATTGTGCTCAGATGCTTGAGTTTCCTCTCACTTTCGGAGCCGGCACCAAACTGGAACTGAAA |
| 4A11.H1L1 (IMT006b) | 636 | GATATAGTGATGACCCAAACACCTTTGTCCCTGTCAGTCACCCCAGGCCAACCCGCATCTATCTCATGCAAATCCTCAAAAAGTCTTTTGCACTCTGACGGGATAACATATCTCTACTGGTATCTTCAAAAACCTGGTCAGTCCCCCAGCTCTTGATCTATAGAATGAGTAACCTTGCCTCTGGTGTCCCCGACCGGTTTAGTGGAAGCGGGTCTGGGACCGACTTCACCCTCAAGATTAGTCGCGTCGAAGCCGAAGATGTGGGAGTGTATTACTGTGCCCAGATGCTCGAATTTCCCCTGACATTTGGTCAAGGAACTAAATTGGAGATTAAG |
| 4A11.H4L2 (IMT006c) | 637 | GATATTGTAATGACCCAAAGCCCCCTGTCCTTGCCTGTTACCCCAGGTGAGCCTGCCAGCATATCTTGCCGATCCAGTAAATCTCTGCTTCATAGCGATGGCATCACCTATTTGTATTGGTATTTGCAGAGACCCGGCCAGAGCCCCCAGTTGCTGATCTACAGAATGTCCAACCTTGCTAGTGGAGTGCCCGACCGGTTTAGCGGTTCAGGCTCAGGGACTGATTTCACTCTTAAAATCAGTAGGGTAGAGGCCGAAGACGTTGGTGTATATTATTGTGCTCAGATGTTGGAGTTTCCACTCACATTTGGACAAGGTACAAAGCTGGAAATTAAG |
| 4G2.2G6 | 638 | GATGTCGTAATGACTCAAAACCCCCTGACCCTTAGTGTTACTATAGGCCAGCCCGCAAGCATCTCCTGCAAATCCTCCCAGTCTCTTCTTTATACTGATGGCAAAACCTACTTGTCCTGGTTTTTGCAGCGCCCAGGTCAAAGTCCTAAACGTCTTATTTACTTGGTCTCTAAACTCGATTCCGGCGTGCCTGACCGGTTCTCCGGTAGCGGTAGCGGTACCGATTTCACTTTGAAGATTAGCCGAGTTGAGGCAGAAGACCTCGGGGTCTACTACTGCCTTCAGAGTACACACTTCCCACTTACATTTGGCGCAGGAACCAAGTTGGAGGTTAAA |
| 6B3.2D3 | 639 | AGTATTGTGATGACCCAGACTCCCAAATTCCTGCTTGTATCAGCAGGAGACAGGGTTACCATAACCTGCAAGGCCAGTCAGAGTGTGAGTAATGATGTAGCTTGGTACCAACAGAAGCCAGGGCAGTCTCCTAAATTGTTGATATATTATGCATCCAATCGCTACACTGGAGTCCCTGATCGCTTCACTGGCAGTGGATATGGGACGGATTTCACTTTCACCATCAGCACTGTGCAGGCTGAAGACCTGGCAGTTTATTTCTGTCAGCAGGATTATACCTCTCCGTACACGTTCGGAGGGGGGACCAAGCTGGAAATAAAA |
| 6H6.2D6 | 640 | GACATCCAGATGACCCAGACCACCTCCTCCCTGTCCGCCTCCCTGGGCGACAGGGTGACCATCTCCTGCTCCGCCTCCCAGGGCATCTCCAACTACCTGAACTGGTACCAGCAGAAGCCCGACGGCACCGTGAAGCTGCTGATCTACTACACCTCCTCCCTGCACTCCGGCGTGCCCTCCAGGTTCTCCGGCTCCGGCTCCGGCACCGACTACTCCCTGACCATCTCCAACCTGGAGCCCGAGGACATCGCCACCTACTACTGCCAGCAGTACTCCGAGCTGCCCTACACCTTCGGCTCCGGCACCAAGCTGGAGATCAAG |
| 9H2.2H10 | 641 | GACATTGTGATGACCCAGTCTCACAAATTCATGTCCACATCAGTAGGAGACAGGGTCAGCATCACCTGCAAGGCCAGTCAGGATGTGAGTACTGCTGTAGCCTGGTATCAACAAAAACCAGGGCAATCTCCTAAACTACTGATTTACTGGGCATCCACCCGGCACACTGGAGTCCCTGATCGCTTCACAGGCAGTGGATCTGGGACAGATTATACTCTCACCATCAGCAGTGTGCAGGCTGAAGACCTGGCACTTTATTACTGTCAGCAACATTATACCACTCCGCTCACGTTCGGTGCTGGGACCAAGCTGGAGCTGAAA |

Figure 30 cont.

| Antibody | SEQ ID NO: | V_L nucleic acid sequence |
|---|---|---|
| 13G4.2F8 | 642 | GACATTGTGATGACCCAGTCTCAAAAATTCATGTCCACATCAGTAGGAGAGAGGG TCAGCATCACCTGCAAGGCCAGTCAGAATGTAGGTACTAATGTAGCCTGGTATCA GCAGAAAGCAGGGCAGTCTCTTGAACTGCTGATCTATGGGGCATCCAACCGGCAC ACTGGAGTCCCTGATCGCTTCACAGGCAGTGGATCTGGGACAGATTTCACTCTCA CCATCACCAATGTGCAGTCTGAAGACATGACAAATTATTTCTGTGAGCAATATAG CAACTTTCCTCTCACGTTCGGTGCTGGGACCAAGCTGGAGCTGAAA |
| 13H12.2F8 | 643 | GACGTTGTTATGACACAAACACCACTTACACTTTCTGTAACTATCGGTCAGCCTGC CTCAATTTCATGTAAGTCTTCTCAGTCCCTGTTTCATAGCGACGGGAAGACTTACC TGAATTGGCTTCTCCAACGACCAGGCCAATCACCCAAGCGCCTTATTTATTTGGTC AGTAAATTGGACAGTGGAGTTCCCGATAGATTTACCGGGAGCGGTTCTGGGACCG ATTTCACCCCAAAGATCTCCAGGGTAGAAGACGAAGATCTCGGTGTGTACTATTG CTGGCAGGGGACACATTTCCCTCTGACATTCGGTGCTGGAACCAAACTTGAGATG AAA |
| 15G7.2A7 | 644 | GACATCCAGATGAACCAGTCTCCATCCAGTCTGTCTGCATCCCTCGGAGACACAA TTTCCATCACTTGCCGTGCCAGTCAGAACATTAATATTTGGTTAAGCTGGTACCAG CAGAAACCAGGAAAATATTCCTCAACTATTGATCTATAAGGCTTCCAACTTGCACA CAGGCGTCCCCTCAAGGTTTAGTGGCAGTGGATCTGGAACAGATTTCACATTAAC CATCAGCAGTCTGCAGCCTGAAGCATTGCCACTTACTACTGTCTACAGGGTCAA AGTTATCCTCTCACGTTCGGTGCTGGGACCAAGCTGGTGATGAAA |
| 19D9.2E5 | 645 | GATGTTGTGATGACCCAGACTCCACTCACTTTGTCGGTTACCATTGGACAACCAGC CTCCATCTCTTGTAAGTCAAGTCAGAGCCTCTTACATAGTGATGGAAAGACATATT TGAATTGGTTGTTACAGAGGCCAGGCCAGCCTCCAAAGCGCCTAATGTATCTGGT GTCTACACTGGACTCTGGAGTCCCTGACAGGTTCACTGGCAGTGGATCAGGGACA GATTTCACACTGAAAATCAGCAGAGTGGAGGCTGAGGATTTGGGAGTTTATTATT GCTGGCAAGGTACACATTTTCCTCTCACGTTCGGTGCTGGGACCAAGCCGGAG |
| 23B10.2B12 | 646 | GATATTGTGATGACGCAGGCTGCATTCTCCAATCCAGTCACTCTTGGAACGTCAGC TTCCATCTCCTGCAGGTCTAGTAAGAGTCTCCTACATAGTGATGGCATCACTTATT TCTATTGGTATCTGCAGAGGCCAGGCCAGTCTCCTCAGCTCCTGATATATCGGATG TCCAACCTTGCCTCAGGAGTCCCAGACAGGTTCAGTGGCAGTGGGTCAGGAACTG ATTTCACACTGAGAATCAGCAGAGTGGAGGCTGAGGATGTGGGTGTTTATTACTG TGCTCAAATGCTAGAATTCCCGCTCACGTTCGGTGCTGGGACCAAGCTGGAG |
| 24D12.2H9 | 647 | GACATTGTGATGACCCAGTCTCACAAATTCATGTCCACATCAGTAGGAGACAGGG TCAGCATCACCTGCAAGGCCAGTCAGGATGTGCGTACTGCTGTAGCCTGGTATCA ACAGAAACCAGGGCAATCTCCTAAACTACTGATTTACTGGGCATCCACCCGGCAC ACTGGAGTCCCTGATCGCTTCACAGGCAGTGGATCTGGGACAGATTTCACTCTCA CCCTTAGCAATGTGCAGTCTGAAGACTTGGCAGATTATTTCTGTCAGCAATATAGT AGTTATCCGTGGACGTTCGGTGGAGGCACCAAGCTGGAAATCAAA |
| F846C.1B2 | 648 | AACATTTGGTTGACACAGTCGCCATCATCTCTGGCTGTGTCTGCAGGAGAAATGG TCACTATGACCTGTAAGTCCAGTCAAAGTGTTTTATACAGTTCAAATCAGAAGAA CTACTTGGCCTGGTACCAGCAGAAACCAGGGCAGTCTCCTAAACTGCTGATCTAC TGGGCATCCACTAGGGAATCTGGTGTCCCTGATCGCTTCACAGGCAGTGGATCTG GGACAGACTTTTCTCTTACCATCAGCAGTGTACAAGCTGAAGACCTGGCAGTTTAT TACTGTCATCAATATCTCTCCTCGCTCACGTTCGGTGCTGGGACCAAGCTGGAGCT GAAA |

Figure 30 cont.

| Antibody | SEQ ID NO: | V_L nucleic acid sequence |
|---|---|---|
| F846C.1F5 | 649 | AACATTATGATGACACAGTCGCCATCATCTCTGGCTGTGTCTGCAGGAGAAAAGGTCACTATGAGCTGTAAGTCCAGTCAAAGTGTTTTATACAGTTCAAATCAGAAGAACTACTTGGCCTGGTACCAGCAGAAACCAGGGCAGTCTCCTAAACTGCTGATCTACTGGGCATCCACTAGGGAATCTGGTGTCCCTGATCGCTTCACAGGCAGTGGATCTGGGACAGATTTTACTCTTACCATCAGCAGTGTACAACCTGAAGACCTGGCAGTTTATTACTGTCATCAATACCTCTCCTCGCTCACGTTCGGTGCTGGGACCAAGCTGGAGCTGAAA |
| F846C.1H12 | 650 | AACATTATGATGACACAGTCGCCATCATCTCTGGCTGTGTCTGCAGGACAAAAGGTCACTATGAGCTGTAAGTCCAGTCAAAGTGTTTTATACAGTTCAAGTCAGAAGAACTACTTGGCCTGGTACCAGCAGAAACCAGGGCAGTCTCCTAAACTTCTGATCTACTGGGCATCCACTAGGGAATCTGGTGTCCCTGATCGCTTCTCAGGCAGTGGATCTGGGACAGATTTTACTCTTACCATCAGCAGTGTACAACCTGAAGACCTGGCAGTTTATTACTGTCATCAATACCTCTCCTCGCTCACGTTCGGTGCTGGGACCAAGCTGGAGCTGAAA |
| F846C.1H5 | 651 | GATGTTGTGATGACCCAAACTCCACTCTCCCTGCCTGTCAGTCTTGGAGATCAAGCCTCCATCTCTTGCAGATCTAGTCAGAGCCTTGTACACAATAGTGGAAACACCTATTTACATTGGTACCTGCAGAGGCCAGGCCAGTCTCCAAACCTCCTGATCTACAAAGTTTCCAACCGATTTTCTGGGGTCCCAGACAGGTTCAGTGGCAGTGGATCAGGGACAGATTTCACACTCAAGATCAGCAGAGTGGCGGCTGAGGATCTGGGAGTTTATTTCTGCTCTCAAAGTACACATGTTCCTCCGACGTTCGGTGGAGGCACCAAGCTGGAAATCAAA |
| F846C.2H3 | 652 | AACATTATGATGACACAGTCGCCATCATCTCTGGCTGTGTCTGCAGGAGAAAAGGTCACTATGAGCTGTAAGTCCAGTCAAAGTGTTTTATACAGTTCAAATCAGAAGAACTACTTGGCCTGGTACCAGCAGAAACCAGGGCAGTCTCCTAAACTGCTGATCTACTGGGCATCCACTAGGGAATCTGGTGTCCCTGATCGCTTCACAGGCAGTGGATCTGGGACAGATTTTACTCTTACCATCAGCAGTGTACAACCTGAAGACCTGGCAGTTTATTACTGTCATCAATACCTCTCCTCGCTCACGTTCGGTGCTGGGACCAAGCTGGAGCTGAAA |
| F846TC.14A2 | 653 | CAGGCTGTTGTGACTCAGGAATCTGCACTCACCACATCACCTGGTGAAACAGTCACACTCACTTGTCGCTCAAGTACTGGGGCTGTTACAACTAGTAACTATGCCAACTGGGTCCAAGAAAAACCAGATCATTTATTCACTGGTCTAATAGGTGGTATCAATAACCGAGTTCCAGGTGTTCCTGCCAGATTCTCAGGCTCCCTGATTGGAGACAAGGCAGCCCTCACCATCACAGGGGCACAGACTGAGGATGAGGCAATATATTTCTGTGCTCTATGGTATAGCAACCATTGGGTGTTCGGTGGAGGAACCAAACTGACTGTCCTA |
| F846TC.14E4 | 654 | GATATTGTGATGACGCAGGCTGCATTCTCCAATCCAGTCACTCTTGGAACATCAGCTTCCATCTCCTGCAGGTCTAGTAAGAGTCTCCTACATACTAATGGCATCACTTTTTTGTATTGGTATCTGCAGAAGCCAGGCCAGTCTCCTCAGCCCCTGATTTATCAGATGTCCAACCTTGCCTCAGGAGTCCCAGACAGGTTCAGTAGCAGTGGGTCAGGAACTGATTTCACACTGAGAATCAGCAGAGTGGAGGCTGAGGATGTGGGTGTTTATTACTGTGCTCAAAATCTAGAACTTCCTTGGACGTTCGGTGGAGGCACCAAGCTGGAAATCAAT |
| F846TC.16B5 | 655 | AACATTATGATGACACAGTCGCCATCATCTCTGGCTGTGTCTGCAGGAGAAAAGGTCACTATGAGCTGTAAGTCCAGTCAAAGTGTTTTATACAGTTCAAATCAGAAGAACTACTTGGCCTGGTACCAGCAGAAACCAGGGCAGTCTCCTAAACTACTGATCTACTGGGCATCCACTAGGGAATCTGGTGTCCCTGATCGCTTCACAGGCAGTGGATCTGGGACAGATTTTACTCTTACCATCAGCAGTGTACAAGCTGAAGACCTGGCAGTTTATTACTGTCATCAATACCTCTCCTCGCTCACGTTCGGTGCTGGGACCAAGCTGGAGCTGAAA |

Figure 30 cont.

| Antibody | SEQ ID NO: | V_L nucleic acid sequence |
|---|---|---|
| F846TC.7F10 | 656 | GACATTGTGATGACACAGTCTCCATCCTCCCTGGCTATGTCAGTAGGACAGAAGG TCACTATGAGCTGCAAGTCCAGTCAGAGCCTTTTAAATAGTAGCAATCAAAAGAA CTATTTGGCCTGGTACCAGCAGAAACCAGGACAGTCTCCTAAACTTCTGGTATACT TTGCATCCACTAGGGAATCTGGGGTCCCTGATCGCTTCATAGGCAGTGGATCTGG GACAGATTTCACTCTTACCATCAGCAGTGTGCAGGCTGAAGACCTGGCAGATTAC TTCTGTCAGCAACATTATAGCACTCCGTACACGTTCGGAGGGGGGGCCAAGCTGG AAATAAAA |
| F847C.10B9 | 657 | GACATCCGGATGACTCAGTCTCCATCCAGTCTGTCTGCATCCCTTGGAGACACAAT TACCATCACTTGCCATGCCAGTCAGAACATTAATGTTTGGTTAAGCTGGTACCAGC AGAAACCAGGAAATATTCCTAAACTATTGATCTATAAGGCTTCCAACTTGCACAC AGGCGTCCCATCAAGGTTTAGTGGCAGTGGATCTGGAACAGGTTTCACATTAACC ATCAGCAGCCTGCAGCCTGAAGACATTGCCACTTACTACTGTCAACAGGGTCAAA GTTATCCGTACACGTTCGGAGGGGGGACCAAGCTGGAGCTGAAA |
| F847C.11B1 | 658 | GAAATTGTGTTGACCCAGTCTCCAGCATCCCTGTCCGTGACTACAGGAGAAAAAG TCACTATCAGATGCATAACCAGCATTGATATTGATGATATATGAACTGGTACCA GCAGAAGCCAGGGGAACCTCCTAAGCTCCTTATTTCAGAAGGCAATACTCTTCGT CCTGGAGTCCCATCCCGATTCTCCAGCAGTGGCTATGGCACAGATTTTGTTTTTAC AATTGAAAACACGCTCTCAGAAGATGTTGCAGATTACTACTGTTTGCAAAGTGAT AACAAGCCTCTCACGTTCGGTGCTGGGACCAAGCTGGAGCTGAAA |
| F847C.12F12 | 659 | GACATCCAGGTGATTCAGTCTCCATCCAGTCTGTCTGCATCCCTTGGAGACACAAT TACCATCACTTGCCATGCCAGTCAGAACATTAATGTTTGGTTAAGCTGGTACCAGC AGAAACCAGGAAATATTCCTAAACTATTGATCTATAAGGCTTCCAACTTGCACAC AGGCGTCCCATCAAGGTTTAGTGGCAGTGGATCTGGAACAGGTTTCACATTAACC ATCAGCAGCCTGCAGCCTGAAGACATTGCCACTTACTACTGTCAACAGGGTCAAA GTTATCCGTACACGTTCGGAGGGGGGACCAAGCTGGAGCTGAAA |
| F847C.26F5 | 660 | GAAATTAAGATGAACCAGTCTCCATCCAGTCTGTCTGCATCCCTTGGAGACACAA TTACCATCACTTGCCATGCCAGTCAGAACATTAATGTTTGGTTAAGCTGGTACCAG CAGAAACCAGGAAATATTCCTAAACTATTGATCTATAAGGCTTCCAACTTGCACA CAGGCGTCCCATCAAGGTTTAGTGGCAGTGGATCTGGAACAGGTTTCACATTAAC CATCAGCAGCCTACAGCCTGAAGACATTGCCACTTACTACTGTCAACAGGGTCAA AGTTATCCGTACACGTTCGGAGGGGGGACCAAGCTGGAGCTGAAA |
| F847C.4B10 | 661 | CAGGCTGTTGTGACTCAGGAATCTGCACTCACCACATCACCTGGTGAAACAGTCA CACTCACTTGTCGCTCAAGTACTGGGGCTGTTACAACTAGTAACTATGCCAACTGG GTCCAAGAAAAACCAGATCATTTATTCACTGGTCTAATAGGTGGTACCAACAACC GAGCTCCAGGTGTTCCTGCCAGATTCTCAGGCTCCCTGATTGGAGACAAGGCTGC CCTCACCATCACAGGGGCACAGACTGAGGATGAGGCAATATATTTCTGTGCTCTA TGGTACAGCAACCATTTAGTGTTCGGTGGAGGAACCAAACTGACTGTCCTA |
| F849C.8D10 | 662 | GATGTTTTGATGACCCAAACTCCACTCTCCCTGCCTGTCAGTCTTGGAGATCAAGC CTCCATCTCTTGCAGATCTAGTCAGGACATTGTGCATAGTAGTGGAAACACCTATT TAGAATGGTACCTGCAGAAACCAGGCCAGTCTCTAAAGCTCCTGATTTACAAAGT TTCCAACCGATTTTCTGGGGTCCCAGACAGGTTCAGTGCCAGTGGATCAGGGACA GATTTCACACTCAAGATCAGCAGAGTGGAGGCTGAGGATCTGGGAGTTTATTACT GCTTTCAAGGTTCACATGTTCCTCCACGTTCGGCTCGGGGACAAAGTTGGAAAT AAAA |

Figure 30 cont.

| Antibody | SEQ ID NO: | V_L nucleic acid sequence |
|---|---|---|
| F849C.8H3 | 663 | GATATTGGGATGAGGCAGGCTGCATTCTCCAATCCAGTCACTCTTGGAACATCAGCTTCCATCTCCTGCAGGTCTAGTAAGAGTCTCCTATATAGTAATGGCATCACTTATTTGTATTGGTTTCTCCAGAAGCCAGGCCAGTCTCCTCAGCTCCTGATTTATCAGATGTCCAACCTTGCCTCAGGAGTCCCAGACAGGTTCAGTAGCAGTGGGTCAGGAACTGATTTCACACTGAGAATCAGCAGAGTGGAGGCTGACGATGTGGGTGTTTATTACTGTGCTCAAAATCTAGAACTTCCGTGGACGTTCGGTGGAGGCACCAAGCTGGAAATCAAA |
| 846.2B11 | 664 | GACATTGTGCTGACACAGTCTCCTGCTTCCTTAGGTGTTTCTCTGGGGCAGAGGGCCACCATCTCATGCAGGGCCAGCAAAAGTGTCAGTACATCTGGCTATAGTTATATGCACTGGTACCAACAGAAACCAGGACAGCCACCCAAACTCCTCATCTATCTTGCATCCATCCTAGAATCTGGGGTCCCTGCCAGGTTCAGTGGCAGTGGGTCTGGGACAGACTTCACCCTCAACATCCATCCTGTGGAGGAGGAGGATGCTGCAATCTATTACTGTCAGCACAGTAGGGAGCTTCCTCTCACGTTCGGTGCTGGGACCAAGCTGGAGCTGAAA |
| 846.4D5 | 665 | AACATTGTGCTGACCCAATCTCCAGCTTCTTTGGCTGTGTCTCTAGGGCAGAGGGCCACCATATCCTGCAGAGCCAGTGAAAGTGTTGATAGTTATGGCAATAGTTTTATGCACTGGTACCAGCAGAAACCAGGACAGCCACCCAAACTCCTCATCTATCTTGCATCCAACCTAGAATCTGGGGTCCCTGCCAGGTTCAGTGGCAGTGGGTCTAGGACAGACTTCACCCTCACCATTGATCCTGTGGAGGCTGATGATGCTGCAACCTATTACTGTCAGCAAAATAATGAGGATCCGTGGACGTTCGGTGGAGGCACCAAGCTGGAAATCAAA |
| 846T.1H2 | 666 | GATGTTGTGATGACCCAGACTCCACTCACTTTGTCGGTTACCATTGGACAACCAGCCTCTATCTCTTGCAAGTCAAGTCAGAGTCTCTTATATAGTAATGGAAAAACCTATTTGAATTGGTTATTACAGAGGCCAGGCCAGTCTCCAAAGCGCCTAATCTATCTGGTGTCTAAACTGGACTCTGGAGTCCCTGACAGGTTCACTGGCAGTGGATCAGGAACAGATTTTACACTGAAAATCAGCAGAGTGGAGGCTGAGGATTTGGGAGTTTATTACTGCGTGCAAGGTACACATTTTCCTCAGACGTTCGGTGGAGGCACCAAGCTGGAAATAAAA |
| 847.14H4 | 667 | CAGGCTGTTGTGACTCAGGAATCTGCACTCACCACATCACCTGGTGAAACAGTCACACTCACTTGTCGCTCAAGTACTGGGGCTGTTACAACTAGTAACTATGCCAACTGGGTCCAAGAAAAACCAGATCATTTATTCACTGGTCTAATAGGTGGTACCAACAACCGAGCTCCAGGTGTTCCTGCCAGATTCTCAGGCTCCCTGATTGGAGACAAGGCTGCCCTCACCATCACAGGGGCACAGACTGAGGATGAGGCAATATATTTCTGTGCTCTATGGTACAGCAACCATTTAGTGTTCGGTGGAGGAACCAAACTGACTGTCCTA |
| 846.2D4 | 668 | AACATTGTGCTCACCCAATCTCCAGCTTCTTTGGCTGTGTCTCTAGGGCAGAGGGCCACCATATCCTGCAGAGCCAGTGAAAGTGTTGATAGTTATGGCAATAGTTTTATGCACTGGTACCAGCAGAAACCAGGACAGCCACCCAAACTCCTCATCTATCTTGCATCCAACCTAGAATCTGGGGTCCCTGCCAGGTTCAGTGGCAGTGGGTCTAGGACAGACTTCACCCTCACCATTGATCCTGTGGAGGCTGATGATGCTGCAACCTATTACTGTCAGCAAAATAATGAGGATCCGTGGACGTTCGGTGGAGGCACCAAGCTGGAAATAAAA |
| 846.2F11 | 669 | GACATCCTGATGACCCAATCTCCATCCTCCATGTCTGTATCTCTGGGAGACACAGTCAGCATCACTTGCCATGCAAGTCAGGGCATTAACAGTAATATAGGGTGGTTGCAGCAGAAACCAGGGAAGTCATTTAAGGGCCTGATCTATCATGGAACCAACTTGGAAGATGGAGTTCCATCAAGGTTCAGTGGCAGTGGATCTGGAGCAGATTATTCTCTCACCATCAGCAGCCTGGAATCTGAAGATTTTGCGGACTATTACTGTGTACAGTATGATCAGTTTCCGTGGACGTTCGGTGGAGGCACCAAGCTGGAAATCAAA |

Figure 30 cont.

| Antibody | SEQ ID NO: | V_L nucleic acid sequence |
|---|---|---|
| 846T.10B1 | 670 | GACATTGTGATGTCACAGTCTCCTGCTTCCTTAGGTGTTTCTCTGGGGCAGAGGGCCACCATCTCATGCAGGGCCAGCAAAAGTGTCAGTACATCTGGCTATAGTTATATGCACTGGTACCAACAGAAACCAGGACAGCCACCCAAACTCCTCATCTATCTTGCATCCATCCTAGAATCTGGGGTCCCTGCCAGGTTCAGTGGCAGTGGGTCTGGGACAGACTTCACCCTCAACATCCATCCTGTGGAGGAGGAGGATGCTGCAATCTATTACTGTCAGCACAGTAGGGAGCTTCCTCTCACGTTCGGTGCTGGGACCAAGCTGGAGCTGAAA |
| 846T.2E3 | 671 | GACATTGTGCTGACACAGTCTCCTGCTTCCTTAGCTGTATCTCTGGGGCAGAGGGCCACCATCTCATGCAGGGCCAGCAAAAGTGTCAGTACATCTGGCTATAGTTATATGCACTGGTACCAACAGAAACCAGGACAGCCACCCAAACTCCTCATCTATCTTGCATCCATCCTAGAATCTGGGGTCCCTGCCAGGTTCAGTGGCAGTGGGTCTGGGACAGACTTCACCCTCAACATCCATCCTGTGGAGGAGGAGGATGCTGCAACCTATTACTGTCAGCACAGTAGGGAGCTTCCTCTCACGTTCGGTGCTGGGACCAAGCTGGAGCTGAAA |
| 846T.4C9 | 672 | GACATTTTGATGACCCAAACTCCATCCTCCATGTCTGTATCTCTGGGAGACACAGTCAGCATCACTTGCCATGCAAGTCAGGGCATTAGCAGTAATATAGGGTGGTTGCAGCAGAAACCACGGAAATCATTTAAGGGCCTGATCTATTATGGAACCAACTTGGAAGATGGAGTTCCATCAAGGTTCAGTGGCAGTGGATCTGGAACAGATTATTCTCTCACCATCAGCAGCCTGGAATCTGAAGATTTTGCAGACTATTACTGTGTACAGTATGATCAGTTTCCGTGGACGTTCGGTGGAGGCACCAAGCTGGAAATAAAA |
| 846T.4E11 | 673 | GACATTGTGCTGACACAGTCTCCTGCTTCCTTAGCTGTATCTCTGGGGCAGAGGGCCACCATCTCATGCAGGGCCAGCAAAAGTGTCAGTACATCTGGCTATAGTTGTATGCACTGGTACCAACAGAAACCAGGACAGCCACCCAAACTCCTCATCTATCTTGCATCCAACCTAGAATCTGGGGTCCCTGCCAGGTTCAGTGGCGGTGGGTCTGGGACAGACTTCACCCTCAGCATCCATCCTGTGGAGGAGGAGGATGCTGCAACCTATTACTGTACCACAGTACGGAGCTTCCGTACACGTTCGGAGGGGGGACCAAGCTGGAAGTAGAA |
| 846T.4F5 | 674 | GACATTGTGCTGACCCAATCTCCAGCTTCTTTGGCTGTGTCTCTAGGGCAGAGGGCCACCATATCCTGCAGAGCCAGTGAAAGTGTTGATAGTTATGGCAATAGTTTTATGCACTGGTACCAGCAGAAACCAGGACAGCCACCCAAACTCCTCATCTATCTTGCATCCAACCTAGAATCTGGGGTCCCTGCCAGGTTCAGTGGCAGTGGGTCTAGGACAGACTTCACCCTCACCATTGATCCTGTGGAGGCTGATGATGCTGCAACCTATTACTGTAGCAAAATAATGAGGATCCGTGGACGTTCGGTGGAGGCACCAAGCTGGAAATCAAA |
| 846T.8D1 | 675 | GACATTGTGCTGACACAGTCTCCTGCTTCCTTAGCTGTATCTCTGGGGCAGAGGGCCACCATCTCATGCAGGGCCAGCAAAAGTGTCAGTACATCTGGCTATAGTTATATGCACTGGTACCAACAGAAACCAGGACAGCCACCCAAACTCCTCATCTATCTTGCATCCATCCTAGAATCTGGGGTCCCTGCCAGGTTCAGTGGCAGTGGGTCTGGGACAGACTTCACCCTCAACATCCATCCTGTGGAGGAGGAGGATGCTGCAACCTATTACTGTCAGCACAGTAGGGAGCTTCCTCTCACGTTCGGTGCTGGGACCAAGCTG |
| 847.10C9 | 676 | GATGTTGTGATGACCCAGACTCCACTCACTTTGTCGGTTACCATTGGACAACCAGCCTCTATCTCTTGCAAGTCAAGTCAGAGCCTCTTATATAGTGATGGAAAAACCTATTTGAATTGGTTATTACAGAGGCCAGGCCAGTCTCCAAAGCGCCTAATCTATCTGGTGTCTCAACTGGACTCTGGAGTCCCTGACAGGTTCACTGGCAGTGGATCAGGAACAGATTTTACACTGAAAATCAGCAGAGTGGAGGCTGATGATTTGGGAGTTTATTGCTGCGTGCAAGGTACACATCTTCCCACGTTCGGAGGGGGGACCAAGCTGGAAATAAAA |

Figure 30 cont.

| Antibody | SEQ ID NO: | V_L nucleic acid sequence |
|---|---|---|
| 847.11D6 | 677 | GACATTGTGATGACACAGTCTCCCGCTTCTTTGGCTGTGTCTCTAGGGCAGAGGGCCACCATATCCTGCAGAGCCAGTGAAAGTGTTGAAAATCATGTCAATAGTTTTATGCACTGGTTCCAACAGAAACCAGGACAGCCACCCAAACTCCTCATCTATCGTGCATCCAACCTACAATCTGGGATCCCTGCCAGGTTCAGTGGCAGTGGGTCTAGGACAGACTTCACCCTCACCATTAATCCTGTGGAGGCTGATGATGTTGCAACCTATTACTGTCAGCAAAATAATGAGGTCCCGTACACGTTCGGAGGGGGGACCAAGCTGGAAATAAAA |
| 847.15D12 | 678 | CAGGCTGTTGTGACTCAGGAATCTGCACTCACCACATCACCTGGTGAAACAGTCACACTCACTTGTCGCTCAAGTACTGGGGCTGTTACAACTAGTAACTATGCCAACTGGGTCCAAGAAAAACCAGATCATTTATTCACTGGTCTAATAGGTGGTACCAACAACCGAGCTCCAGGTGTTCCTGCCAGATTCTCAGGCTCCCTGATTGGAGACAAGGCTGCCCTCACCATCACAGGGGCACAGACTGAGGATGAGGCAATATATTTCTGTGCTCTATGGTACAGCAACCATTTGGTGTTCGGTGGAGGAACCAAACTGACTGTCCTA |
| 847.15F9 | 679 | CAAATTGTTCTCTCCCAGTCTCCAGCAATCCTGTCTGCATCTCCAGGGGAGAAGGTCACAATGACTTGCAGGGCCAGCTCAAGTGTAACTTACATGTACTGGTACCAGCAGAAGCCAGGATCCTCCCCCCAACCCTGGATTTATGCCACATCCAACCTGGCTTCTGGAGTCCCTGCTCGCTTCAGTGGCAGTGGGTCTGGGACCTCTTACTCTCTCACAATCAGCAGAGTGGAGGCTGAAGATGCTGCCACTTATTACTGCCAGCAGTGGAGTAGTAACCCACTCACGTTCGGTGCTGGGACCAAGCTGGAGCTGAAA |
| 847.15H11 | 680 | GACATTGTGCTAACACAGTCTCCAGCTTCTTTGGCTGTGTCTCTAGGGCAGAGGGCCACCATCTCCTGCAGAGCCAGCGAAAGTCTTGATAATTCTGGCATTAGTTTTATGAACTGGTTCCAACAGAGACCAGGACAGCCACCCAAACTCCTCATCTATGCTGCATCCAACCTAGAATCCGGGGTCCCTGCCAGGTTTAGTGGCAGTGGGTCTGGGACAGACTTCAGCCTCAACATCCATCCTATGGAGGAGGATGATGCTGCAATGTATTTCTGTCAGCACAGTAAGGAGGTTCCGTGGACGTTCGGTGGAGGCACCAAGCTGGAAATCAAA |
| 847.20H7 | 681 | GACATTGTGATGACCCAGTCTCACAAAATCATGTCCACATCAGTAGGAGACAGGGTCAGCATCACCTGCAAGGCCAGTCAGGATGTGAGTACCACTGTGGCCTGGTTTCAGCAAAAACCAGGACAATCTCCTAAACTACTGCTTTACTGGGCATCCACCCGGCACACTGGAGTCCCTGATCGCTTCACAGGCAGTGGATCTGGGACAGATTATACTCTCACCATCAGCAGTGTCCAGGCTGAAGACCTGGCACTTTATTACTGTCAGCAACATTATAGCCCTCCATTCACGTTCGGCTCGGGGACCAAGCTGGAAATAAAA |
| 847.21B11 | 682 | GACATTGTGATGACTCAGTCTCAAAAATTCATGTCCACATCAGTAGGAGACAGGGTCAGCGTCACCTGCAAGGCCAGTCAGAATGTGGGTATTAATGTAGCCTGGTATCAACAGAAACCAGGGCAATCTCCTAAAGCACTGATTTACTCGGCATCCTACCGGTACAGTGGAGTCCCTGATCGCTTCACAGGCAGTGGATCTGGGACAGATTTCACTCTCACCATCAGCAATGTGCAGTCTGAAGACTTGGCAGAGTATTTCTGTCAGCAATATAATAGTTATCCGTACACGTTCGGAGGGGGGACCAAGCTGGAAATGAAA |
| 847.27B9 | 683 | GACGTTGTGATGACCCAGACTCCACTCACTTTGTCGGTTACCCTTGGACAACCCGCCTCCATCTCTTGCAGGTCAAGTCAGAGCCTCTTAGATAGTGATGGAAAGACATATTTGAATTGGTTGTTACAGAGGCCAGGCCAGTCTCCAAAGCGCCTAATCTATTTGGTGTCTAGACTGGACTCTGGAGTCCCTGACAGGTTCACTGGCAGTGGATCAGGGACAGATTTCACACTGAAAATCAGCAGAGTGGAGGCTGAGGATCTGGGAGTTTATTATTGCTGGCAAGGTACACATTTTCCGTTCACGTTCGGAGGGGGGACCAAGCTGGAAATAAAA |

Figure 30 cont.

| Antibody | SEQ ID NO: | V_L nucleic acid sequence |
|---|---|---|
| 847.28D1 | 684 | GACATCCGGATGACTCAGTCTCCAGCCTCCCTATCTGCATCTGTGGGAGAAACTGT CACCATCACATGTCGAGCAAGTGGGAATATTCACAATTATTTAGCATGGTATCAT CAGAAACAGGGAAAATCTCCTCAGCTCCTGGTCTATAATGTAAAAACCTTAGCAG ATGGTGTGCCATCAAGGTTCAGTGGCAGTGGATCAGGAACACAATTTTCTCTCAA GATCAACAGTTTGCAGCCTGAAGATTTTGGGACTTATTATTGTCAACATTTTTGGA GTATTTTTCCGACGTTCGGTGGAGGCACCAAGCTGGAAATAAAA |
| 847.2B8 | 685 | CAAATTCTTCTCTCCCAGTCTCCAGCAATCCTGTCTGCATCTCCAGGGGAGAAGGT CACAATGACTTGCAGGGCCAGCTCAAGTGTAACTTACATGTACTGGTACCAGCAG AAGCCAGGATCCTCCCCCCAACCCTGGATTTATGCCACATCCAACCTGGCTTCTGG AGTCCCTGCTCGCTTCAGTGGCAGTGGGTCTGGGACCTCTTACTCTCTCACAATCA GCAGAGTGGAGGCTGAAGATGCTGCCACTTATTACTGCCAGCAGTGGAGTAGTAA CCCACTCACGTTCGGTGCTGGGACCAAGCTGGAGCTGAAA |
| 847.3B3 | 686 | GACATTTTGATGACTCAGTCTCCAGCCTCCCTATCTGCATCTGTGGGAGAAACTGT CACCATCACATGTCGAGCAAGTGGGAATATTCACAATTATTTAGCATGGTATCAG CAGAAACAGGGAAAATCTCCTCAACTCCTGGTCTATAGTGCAAAAACCTTAGCAG ATGGTGTGCCATCAAGGTTCAGTGGCAGTGGATCAGGAACACAATTTTCTCTCAA GATCGACAGCCTGCAGCCTGAAGATTTTGGGACTTATTACTGTCAACATTTTTGGA GTCTTTTTCCGACGTTCGGTGGAGGCACCAAGCTGGAA |
| 849.1D2 | 687 | GACGTTGTGATGACCCAGACTCCCAAATTCCTGCTTGTATCAGCAGGAGACAGGG TTACCATAACCTGCAAGGCCAGTCAAAGTGTGAGTAGTGATGTAGCTTGGTACCA ACAGAAGCCAGGGCAGTCTCCTAAACTGCTGATATACTTTGCATCCAATCGCTAC ACTGGAGTCCCTGATCGCTTCACTGGCAGTGGATATGGGACGGATTTCACTTTCAC CATCAGCACTGTCCAGGCTGAAGACCTGGCAGTTTATTTCTGTCAGCATAATTATA TCTCTCCGTTCACGTTCGGAGGGGGGACCAAGCTGGAAATAAAA |
| 849.2D7 | 688 | GACATTGTGATGACCCAGTCTCACAAATTCATGTCCACATCAGTAGGAGACAGGG TCAGCATCACCTGCAAGGCCAGTCAGGATGTGAGTACTGCTGTAGCCTGGTATCA ACAAAAACCAGGGCAATCTCCTAAACTACTGATTTACTGGGCATCCACCCGGCAC ACTGGAGTCCCTGATCGCTTCACAGGCAGTGGATCTGGGACAGATTATACTCTCA CCATCAGCAGTGTGCAGGCTGAAGACCTGGCACTTTATTACTGTCAGCAACATTA TAGCACTCCGTACACGTTCGGAGGGGGGACCAAGCTGGAAATAAAA |
| 849.2F12 | 689 | GACATTGCGATGACCCAGTCTCACAAATTCATGTCCACATCAGTAGGAGACAGGG TCAGCATCACCTGCAAGGCCAGTCAGGATGTGAGTACTGCTGTAGCCTGGTATCA ACAAAAACCAGGGCAATCTCCTAAACTACTGATTTACTGGGCATCCACCCGGCAC ACTGGAGTCCCTGATCGCTTCACAGGCAGTGGATCTGGGACAGATTATACTCTCA CCATCAGCAGTGTGCAGGCTGAAGACCTGGCACTTTATTACTGTCAGCAACATTA TAACACTCCGTACACGTTCGGAGGGGGGACCAAGCTGGAAATAAAA |
| 849.4B2 | 690 | GATGTGGGGATGACCCAGACTCCACTCATTTGTCGGTTACCATTGGACAACCAG CTTCCATCTCTTGCAAGTCAAGTCAGAGCCTCTTATATATTAATGGAAAAACCTAT TTGAATTGGTTATTACAGAGGCCAGGCCAGTCTCCAAAACGCCTAATCTATCTGGT GTCTAAATTGGACTCTGGAGTCCCTAACAGATTCAGTGGCAGTGGATCAGGGACA GATTTCACACTGAAAATCAGCAGAGTGGAGGCTGAGGATTTGGGAGTTATTACT GCTTGCAGAGTACACATTTTCCTCAGACGTTCGGTGGAGGCACCAAGCTGGAAAT CAAA |

Figure 30 cont.

| Antibody | SEQ ID NO: | V_L nucleic acid sequence |
|---|---|---|
| 849.4F12 | 691 | GACATCCTGCTGACCCAGTCTCCATCCTCCATGTCTGTATCTCTGGGAGACACAGT CAGCATCACTTGCCATGCAAGTCAGGGCATTAACAGTAATATAGGGTGGTTGCAG CAGAAACCAGGGAAGTCATTTAAGGGCCTGATCTATCATGGAACCAACTTGGAAG ATGGAGTTCCATCAAGGTTCAGTGGCAGTGGATCTGGAGCAGATTATTCTCTCAC CATCAGCAGCCTGGAATCTGAAGATTTTGCGGACTATTACTGTGTACAGTATGATC AGTTTCCGTGGACGTTCGGTGGAGGCACCAAGCTGGAAATCAAA |
| 849.4F2 | 692 | GATGTTGGGATGACCCAGACTCCACTCATTTGTCGGTTACCATTGGACAACCAGC TTCCATCTCTTGCAAGTCAAGTCAGAGCCTCTTATATATTAATGGAAAAACCTATT TGAATTGGTTATTACAGAGGCCAGGCCAGTCTCCAAAACGCCTAATCTATCTGGT GTCTAAATTGGACTCTGGAGTCCCTAACAGATTCAGTGGCAGTGGATCAGGGACA GATTTCACACTGAAAATCAGCAGAGTGGAGGCTGAGGATTTGGGAGTTTATTACT GCTTGCAGAGTACACATTTTCCTCAGACGTTCGGTGGAGGCACCAAGCTGGAAAT CAAA |
| 849.5C2 | 693 | GATATTGTGATGACTCAGGCTGCACCCTCTGTACCTGTCACTCCTGGAGAGTCAGT ATCCATCTCCTGCAGGTCTAGTAGGAGTCTCCTGCATAGTAATGGCTACACTTACT TGTATTGGTTCCTGCAGAGGCCAGGCCAGTCTCCTCGGCTCCTGATATATCGGATG TCCAACCTTGCCTCAGGAGTCCCAGACAGGTTCAGTGGCAGTGGGTCAGGAACTG CTTTCACACTGAGAATCAGTAGAGTGGAGGCTGAGGATGTGGGTGTTTATTACTG TATGCAACATCTAGAATATCCGTACACGTTCGGAGGGGGGACCAAGCTGGAAATA AAA |
| 849.8D12 | 694 | GACATCCAGATGACACAGACTACATCCTCCCTGTCTGCCTCTCTGGGAGACAGAG TCACCATCAGTTGCAGTGCAAGTCAGGGCATTAGCAATTATTTAAACTGGTATCA GCAGAAACCAGATGGAACTGTTAAACTCCTGATCTATTACACATCAAGTTTACAC TCAGGAGTCCCATCAAGGTTCAGTGGCAGTGGGTCTGGGACAGATTATTCTCTCA CCATCAGCAACCTGGAACCTGAAGATATTGCCACTTACTATTGTCAGCAGTATAG TAAGCTTCCTCGGACGTTCGGTGGAGGCACCAAGCTGGAAATC |
| F847C.21H6 | 695 | GATGTTGTGATGACCCAGACTCCACTCACTTTGTCGGTTACCATTGGACAACCAGC CTCCATCTCTTGCAAGTCAAGTCGGAGCCTCTTAGATAGTGATGGAAAGACATAT TTGAATTGGTTGTTACAGAGGCCAGGCCAGTCTCCAAAGCGCCTAATCTATCTGGT GTCCAAACTGGACTCTGGAGTCCCTGACAGGTTCACTGGCAGTGGATCAGGGACA GATTTCACACTGAAAATCAGCAGAGTGGAGGCTGAGGATTTGGGAGTTTATTATT GCTGGCAAGGTACACATTTTCCTCAGACGTTCGGTGGAGGCACCAAGCTGGAAAT CAAT |
| 849.5H1 | 696 | GACATCCAGATGAACCAGTCTCCATCCAGTCTGTCTGCATCCCTTGGAGACACAA TTACCATCACTTGCCATGCCAGTCAGAACATTAATGTTGGTTAAGCTGGTACCAG CAGAAACCAGGAAATATTCCTAAACTATTGATCTATCAGGCTTCCAACTTACACA CAGGCGTCCCATCAAGGTTAGTGGCCGTGGATCTGGAACAGGTTTCACATTAAC CATCAGCAGCCTGCAGCCTGAAGACATTGCCACTTACTACTGTCAACAGGGTCAA AGTTCTCCATTCACGTTCGGCTCGGGGACAAAGTTGGAAATAAAA |
| 847.23F11 | 697 | GACATTTTGATGACCCAGTCTCACAAATTCATGTCCACATCAGTAGGAGACAGGG TCAGCATCACCTGCAAGGCCAGTCAGGATGTGAGTTCTGTTGTAGTCTGGTATCA ACAAAAACCAGGACAATCTCCTAAACAACTAATTTACTGGGCATCCACCCGGCAC ACTGGAGTCCCTGATCGCTTCACAGGCAGTGGATCTGGGACAGATTATACTCTCA CCATCAGCAGTGTGCAGGCTGAAGACCTGGCACTTTATTACTGTCAGCAACATTA TAGCACGCCGTACACGTTCGGAGGGGGGACCAAGCTGGAAATAAAA |

Figure 30 cont.

| Antibody | SEQ ID NO: | V_L nucleic acid sequence |
|---|---|---|
| 847.16D10 | 698 | CAGGCTGTTGTGACTCAGGAATCTGCACTCACCACATCACCTGGTGAAACAGTCA CACTCACTTGTCGCTCAAGTACTGGGGCTGTTACAACTAGTAACTATGCCAACTGG GACCAAGAAAAACCAGATCATTTATTCACTGGTCTAATAGGTGGTACCAACAACC GAGCTCCAGGTGTTCCTGCCAGATTCTCAGGCTCCCTGATTGGAGACAAGGCTGC CCTCACCATCACAGGGGCACAGACTGAGGATGAGGCAATATATTTCTGTGCTCTA TGGTACAGCAACCATTTGGTGTTCGGTGGAGGAACCAAGGTCACTGTCCTA |
| 847.13E2-mH0mL1 | 699 | GACATTGTGATGACACAGTCTCCTGCTTCCTTACCTGTATCTCTGGGGCAGAGGGC CACCATCTCATGCAGGGCCAGCAAAAGTGTCACTACATCTGCCTATAGTTATATA CACTGGTACCAACAGAGACCAGGACAGCCACCCAAACTCCTCATCTATCTTGCAT CCAACCTAGAATCTGGGGTCCCTGCCAGGTTCAGTGGCAGTGGGTCTGGGACAGA CTTCACCCTCAACATCCATCCTGTGGAGGAGGAGGATGCTGCAACCTATTACTGTC AGCACAATAGGGAGCTTCCTCCGACGTTCGGTGGAGGCACCAAGCTGGAAATCAA T |
| 847.13E2-mH0mL2 | 700 | GATATTGTGCTAACTCAGTCTCCAGCCACCCTGTCTGTGACTCCAGGAGATAGCGT CAGTTTTTCCTGCAGGGCCAGCCAAATTATTAACAACAACCTACACTGGTATCAA CAAAAATCACATGAGTCTCCTAGGCTTCTCATCAGGTATACTTCCCAGTCCATCTC TGGGATCCCCTCCAGGTTCAGTGGCAGTGGATCAGGGACAGATTTCACTCTCAGT ATCAACAATGTGGAGACTGAAGATTTTGGAATGTATTTCTGTCAACAGACTAACA GCTGGCCTCTCACGTTCGGTGCTGGGACCAAGCTGGAGCTGAAA |
| 847.12C4 | 701 | GATGTTGTGATGACCCAGACTCCACTCACTTTGTCGGTTACCATTGAACAAACAGC CTCCATCTCTTGCAAGTCAAGTCAGAGCCTCTTAGATCGTGATGGAAAGACATATT TGAATTGGTTGTTACAGAGGCCAGGCCAGTCTCCAAAGCGCCTAATCTATCTGGT GTCTAAACTGGACTCTGGAGTCCCTGACAGGTTCACTGGCAGTGGATCAGGGACA GATTTCACACTGAAAATCAGCAGAGTGGAGGCTGAGGATTTGGGAGTTTATTATT GCTGGCAAGGTACACATTTTCCGACGTTCGGTGGAGGCACCAAGCTGGAAATCAA A |
| 847.4D3 | 702 | GATGTTGTGATGACCCAAACTCCCAAATTCCTGCCTATAACAGCAGAAGACAGGG TTACCATTACCTGCAAGGCCAGTCAGAGTGTGAGTAATGAAGTAGCTTGGTACCA ACAGAAGCCAGGGCAGTCTCCTAAACTGCTGATATACTATGCATCCAATCGCTAC ACTGGAGTCCCTGATCGCTTCACTGGCAGTGGATCTGGCACGGATTTCACTTTCAC CATCAGAAGTGTGCAACTTGAAGACCTGGCAGTTTATTTCTGTCAGCAGCATTATA GCTCTCCGTGGACGTTCGGTGGAGGCACCAAGCTGGAAATCAAA |
| 2D10.2B2 (murine; mIgG2A (LALAPG)) | 835 | GATATTGTGATGACGCAGGCTGCATTCTCCAATCCAGTCACTCTTGGAACGTCAGC TTCCATCTCCTGCAGGTCTAGTAAGAGTCTCCTACATAGTGATGGCATCACTTATT TGTATTGGTATCTGCAGAGGCCAGGCCAGTCTCCTCAGCTCCTGATATATCGGATG TCCAACCTTGCCTCAGGAGTCCCAGACAGGTTCAGTGGCAGTGGGTCAGGAACTG ATTTCACACTGAGAATCAGCAGAGTGGAGGCTGAGGATGTGGGTGTTTATTACTG TGCTCAAATGATAGAATTCCCGCTCACGTTCGGTGCTGGGACCATCCTGGAGCTG AAA |

Figure 30 cont.

| Antibody | SEQ ID NO: | HC nucleic acid sequence |
|---|---|---|
| TB001 (IMT001; IMT001-4) | 703 | CAGGTGCAGCTGGTGCAGTCCGGCTCCGAGCTGAAAAAACCCGGCGCCTCCGT GAAAGTGTCCTGCAAAGCCTCCGGCTACACATTCACAAACTACGGCATGAACTG GGTGAGGCAGGCCCCCGGCCAGGGCCTGAAATGGATGGGCTGGATCAACACAA ACACAGGCGAGCCCACATACGTGGAGGAGTTCACAGGCAGGTTCGTGTTCTCCC TGGAGACATCCGTGTCCACAGCCTACCTGCAGATCTCCTCCCTGAAAGCCGAGG ACACAGCCGTGTACTTCTGCGCCCCCTACGACAACTTCTTCGCCTACTGGGGCC AGGGCACAACAGTGACAGTGTCCTCCGCTTCCACCAAGGGACCCAGCGTGTTCC CTCTGGCTCCTTGCTCCAGATCCACCTCCGAGTCTACAGCTGCTCTGGGCTGCCT GGTCAAGGACTACTTTCCTGAGCCTGTGACCGTGTCCTGGAACTCTGGCGCTCT GACATCTGGCGTGCACACCTTTCCAGCTGTGCTGCAGTCCTCCGGCCTGTACTCT CTGTCCTCTGTCGTGACCGTGCCTTCCTCTAGCCTGGGCACCAAGACCTACACCT GTAATGTGGACCACAAGCCTTCCAACACCAAGGTGGACAAGCGCGTGGAATCT AAGTACGGCCCTCCTTGTCCTCCATGTCCTGCTCCAGAGTTTCTCGGCGGACCCT CCGTGTTCCTGTTTCCTCCAAAGCCTAAGGACACCCTGATGATCTCTCGGACCCC TGAAGTGACCTGCGTGGTGGTGGATGTGTCCCAAGAGGATCCCGAGGTGCAGTT CAATTGGTACGTGGACGGCGTGGAAGTGCACAACGCCAAGACCAAGCCTAGAG AGGAACAGTTCAACTCCACCTACAGAGTGGTGTCCGTGCTGACCGTGCTGCACC AGGATTGGCTGAACGGCAAAGAGTACAAGTGCAAGGTGTCCAACAAGGGCCTG CCTTCCAGCATCGAAAAGACCATCTCCAAGGCCAAGGGCCAGCCTAGGGAACC CCAGGTTTACACCCTGCCTCCAAGCCAAGAGGAAATGACCAAGAACCAGGTGT CCCTGACCTGCCTCGTGAAGGGCTTCTACCCTTCCGATATCGCCGTGGAATGGG AGAGCAATGGCCAGCCTGAGAACAACTACAAGACAACCCCTCCTGTGCTGGAC TCCGACGGCAGCTTCTTCCTGTATTCCCGCCTGACCGTGGACAAGTCCAGATGG CAAGAGGGCAACGTGTTCAGCTGCTCCGTGATGCACGAGGCCCTGCACAATCA CTACACCCAGAAGTCCCTGTCTCTGTCCCTGGGCTGATGA |
| TB006 (4A11.H3L1; IMT006; IMT006a) | 704 | CAGATTCAATTGGTTCAGAGCGGCTCAGAACTGAAAAAGCCTGGAGCCAGCGT TAAAGTGAGCTGTAAAGCCAGTGGATACACATTCACCACTTACGTCATGTCCTG GGTTAGACAGGCCCCTGGACAGGGGCTGGAATGGATGGGCTGGATAAACACTC ACTCTGGAGTGCCCACATACGCCGACGACTTTACAGGCAGGTTCGTGTTTTCCC TAGATACTAGTGTGAATACTGCATACTTGCAAATCTCTTCTCTGAAAGCAGAGG ATACCGCCGTGTACTTTTGCACCCGCGATGGGAATGATGGGGATGCCATGGACA ACTGGGGCCAGGGGACGACTGTGACAGTGTCTTCAGCTAGCACCAAGGGCCCC AGCGTGTTTCCTCTCGCTCCCTGCAGCCGGAGCACATCCGAGAGCACCGCTGCT CTGGGCTGTCTCGTGAAGGACTACTTCCCTGAACCCGTCACCGTCAGCTGGAAT AGCGGCGCCCTGACATCCGGCGTCCACACATTCCCCGCTGTCCTGCAGAGCAGC GGCCTGTACAGCCTGAGCTCCGTGGTCACCGTGCCTAGCAGCAGCCTGGGAACA AAGACCTACACCTGCAACGTGGACCATAAGCCCTCCAACACCAAGGTGGACAA GCGGGTGGAATCCAAGTATGGACCCCCCTGTCCTCCTTGCCCTGCTCCTGAATTT CTCGGAGGCCCCTCCGTCTTCCTGTTTCCCCCAAGCCCAAGGACACCCTGATG ATCTCCCGGACACCCGAAGTCACCTGCGTCGTGGTGGATGTCAGCCAGGAAGAT CCCGAGGTGCAGTTCAACTGGTACGTGGACGGAGTGGAGGTGCATAACGCCAA AACCAAGCCCAGGGAAGAGCAGTTCAACAGCACCTATCGGGTCGTGTCCGTGC TCACCGTCCTGCATCAGGATTGGCTCAACGGCAAGGAGTACAAGTGCAAGGTG TCCAACAAGGGCCTGCCCTCCTCCATCGAGAAGACCATCTCCAAGGCTAAGGGC CAACCTCGGGAGCCCCAAGTGTATACCCTCCCTCCCAGCCAGGAGGAGATGAC CAAGAATCAAGTGAGCCTGACCTGCCTCGTGAAGGGATTTTACCCCTCCGACAT CGCTGTGGAATGGGAAAGCAATGGCCAACCTGAGAACAACTACAAGACCACAC CCCCCGTGCTGGACTCCGATGGCTCCTTCTTCCTGTACAGCAGGCTGACCGTGG ACAAATCCCGGTGGCAAGAGGGAAACGTGTTCAGCTGCTCCGTGATGCACGAG GCTCTCCACAACCACTACACCCAGAAGAGCCTCTCCCTGAGCCTCGGCTAGTAA |

Figure 31

| Antibody | SEQ ID NO: | HC nucleic acid sequence |
|---|---|---|
| 12G5.D7 | 705 | CAGGTGCAGCTGAAGCAGTCTGGGGCTGAGCTGGTGAGGCCTGGGGCTTCAGT GAAGCTGTCCTGCAAGGCTTCTGGCTACACTTTCACTGACTACTATATAAACTG GGTGAAGCAGAGGCCTGGACAGGGACTTGAGTGGATTGCAAGGATTTATCCTG GAACTGGTAATACTGACTACAATGAGAAGTTCAAGGGCAGGGCCACACTGACT GCAGAAAACTCCTCCAGCACTGCCTACATGCAGCTCAGCAGTCTGACATCTGAG GACTCTGCTGTCTATTTCTGTGCAAGATTTGCGTATTACTACGGTAGTGGAGGGT ACTTTGACTACTGGGGCCACGGCACCACTCTCACAGTCTCCTCAGCTAGCACCA AGGGCCCCAGCGTGTTTCCTCTCGCTCCCTGCAGCCGGAGCACATCCGAGAGCA CCGCTGCTCTGGGCTGTCTCGTGAAGGACTACTTCCCTGAACCCGTCACCGTCA GCTGGAATAGCGGCGCCCTGACATCCGGCGTCCACACATTCCCCGCTGTCCTGC AGAGCAGCGGCCTGTACAGCCTGAGCTCCGTGGTCACCGTGCCTAGCAGCAGC CTGGGAACAAAGACCTACACCTGCAACGTGGACCATAAGCCCTCCAACACCAA GGTGGACAAGCGGGTGGAATCCAAGTATGGACCCCCCTGTCCTCCTTGCCCTGC TCCTGAATTTCTCGGAGGCCCCTCCGTCTTCCTGTTTCCCCCCAAGCCCAAGGAC ACCCTGATGATCTCCCGGACACCCGAAGTCACCTGCGTCGTGGTGGATGTCAGC CAGGAAGATCCCGAGGTGCAGTTCAACTGGTACGTGGACGGAGTGGAGGTGCA TAACGCCAAAACCAAGCCCAGGGAAGAGCAGTTCAACAGCACCTATCGGGTCG TGTCCGTGCTCACCGTCCTGCATCAGGATTGGCTCAACGGCAAGGAGTACAAGT GCAAGGTGTCCAACAAGGGCCTGCCCTCCTCCATCGAGAAGACCATCTCCAAG GCTAAGGGCCAACCTCGGGAGCCCCAAGTGTATACCCTCCCTCCCAGCCAGGA GGAGATGACCAAGAATCAAGTGAGCCTGACCTGCCTCGTGAAGGGATTTTACC CCTCCGACATCGCTGTGGAATGGGAAAGCAATGGCCAACCTGAGAACAACTAC AAGACCACACCCCCGTGCTGGACTCCGATGGCTCCTTCTTCCTGTACAGCAGG CTGACCGTGGACAAATCCCGGTGGCAAGAGGGAAACGTGTTCAGCTGCTCCGT GATGCACGAGGCTCTCCACAACCACTACACCCAGAAGAGCCTCTCCCTGAGCCT CGGCTAGTAA |
| 13A12.2E5 | 706 | CAGATCCAGTTGGTACAGTCTGGACCTGAGCTGAAGAAGCCTGGAGAGACAGT CAAGATCTCCTGCAAGACTTCTGGGTATAAATTCAAAACCTATGTGATGAGCTG GGTGAAACAGGCTCCAGGAAAGGCTTTAAAGTGGATGGGCTGGATAAACACCT ACTCTGGAGTGCCAACATATGCTGATGACTTCAAGGGACGATTTGCCTTCTCTTT GGAAACCTCTGCCAGCACTGCCTATTTGGAGATCATCAACCTCAAAAATGAGGA CACGGCTACATATTTCTGTGCAAGAGATGGTAACTACGGGGATCCTATGGACTA CTGGGGTCAAGGAACCTCAGTCACCGTCTCCTCAGCTAGCACCAAGGGCCCCAG CGTGTTTCCTCTCGCTCCCTGCAGCCGGAGCACATCCGAGAGCACCGCTGCTCT GGGCTGTCTCGTGAAGGACTACTTCCCTGAACCCGTCACCGTCAGCTGGAATAG CGGCGCCCTGACATCCGGCGTCCACACATTCCCCGCTGTCCTGCAGAGCAGCGG CCTGTACAGCCTGAGCTCCGTGGTCACCGTGCCTAGCAGCAGCCTGGGAACAAA GACCTACACCTGCAACGTGGACCATAAGCCCTCCAACACCAAGGTGGACAAGC GGGTGGAATCCAAGTATGGACCCCCCTGTCCTCCTTGCCCTGCTCCTGAATTTCT CGGAGGCCCCTCCGTCTTCCTGTTTCCCCCCAAGCCCAAGGACACCCTGATGAT CTCCCGGACACCCGAAGTCACCTGCGTCGTGGTGGATGTCAGCCAGGAAGATCC CGAGGTGCAGTTCAACTGGTACGTGGACGGAGTGGAGGTGCATAACGCCAAAA CCAAGCCCAGGGAAGAGCAGTTCAACAGCACCTATCGGGTCGTGTCCGTGCTC ACCGTCCTGCATCAGGATTGGCTCAACGGCAAGGAGTACAAGTGCAAGGTGTC CAACAAGGGCCTGCCCTCCTCCATCGAGAAGACCATCTCCAAGGCTAAGGGCC AACCTCGGGAGCCCCAAGTGTATACCCTCCCTCCCAGCCAGGAGGAGATGACC AAGAATCAAGTGAGCCTGACCTGCCTCGTGAAGGGATTTTACCCCTCCGACATC GCTGTGGAATGGGAAAGCAATGGCCAACCTGAGAACAACTACAAGACCACACC CCCGTGCTGGACTCCGATGGCTCCTTCTTCCTGTACAGCAGGCTGACCGTGGA CAAATCCCGGTGGCAAGAGGGAAACGTGTTCAGCTGCTCCGTGATGCACGAGG CTCTCCACAACCACTACACCCAGAAGAGCCTCTCCCTGAGCCTCGGCTAGTAA |

Figure 31 cont.

| Antibody | SEQ ID NO: | HC nucleic acid sequence |
|---|---|---|
| 14H10.2C9 | 707 | CAGATCCAGTTGGTACAGTCTGGACCTGAGCTGAAGAAGCCTGGAGAGACAGT CAAGATCTCCTGCAAGGCTTCTGGGTATACCTTCACAACCTATGGAATGGGCTG GGTGAAACAGGCTCCAGGAAAGGATTTAAAGTGGATGGGCTGGATAAACACCT ACTCTGGAGTGCCAACATATGCTGATGACTTCAAGGGACGGTTTGCCTTCTCTTT GGAAACCTCTGCCAGCACTGCCTATTTGCAGATCAGCAACCTCAAAAATGAAG ACACGGCTACATATTTCTGTTCAACCCCTTATGAATACGACGGGGCTTACTGGG GCCAGGGGACTCTGGTCACTGTCTCTGCAGCTAGCACCAAGGGCCCCAGCGTGT TTCCTCTCGCTCCCTGCAGCCGGAGCACATCCGAGAGCACCGCTGCTCTGGGCT GTCTCGTGAAGGACTACTTCCCTGAACCCGTCACCGTCAGCTGGAATAGCGGCG CCCTGACATCCGGCGTCCACACATTCCCCGCTGTCCTGCAGAGCAGCGGCCTGT ACAGCCTGAGCTCCGTGGTCACCGTGCCTAGCAGCAGCCTGGGAACAAAGACC TACACCTGCAACGTGGACCATAAGCCCTCCAACACCAAGGTGGACAAGCGGGT GGAATCCAAGTATGGACCCCCTGTCCTCCTTGCCCTGCTCCTGAATTTCTCGGA GGCCCCTCCGTCTTCCTGTTTCCCCCAAGCCCAAGGACACCCTGATGATCTCCC GGACACCCGAAGTCACCTGCGTCGTGGTGGATGTCAGCCAGGAAGATCCCGAG GTGCAGTTCAACTGGTACGTGGACGGAGTGGAGGTGCATAACGCCAAAACCAA GCCCAGGGAAGAGCAGTTCAACAGCACCTATCGGGTCGTGTCCGTGCTCACCGT CCTGCATCAGGATTGGCTCAACGGCAAGGAGTACAAGTGCAAGGTGTCCAACA AGGGCCTGCCCTCCTCCATCGAGAAGACCATCTCCAAGGCTAAGGGCCAACCTC GGGAGCCCCAAGTGTATACCCTCCCTCCCAGCCAGGAGGAGATGACCAAGAAT CAAGTGAGCCTGACCTGCCTCGTGAAGGGATTTTACCCCTCCGACATCGCTGTG GAATGGGAAAGCAATGGCCAACCTGAGAACAACTACAAGACCACACCCCCCGT GCTGGACTCCGATGGCTCCTTCTTCCTGTACAGCAGGCTGACCGTGGACAAATC CCGGTGGCAAGAGGGAAACGTGTTCAGCTGCTCCGTGATGCACGAGGCTCTCC ACAACCACTACACCCAGAAGAGCCTCTCCCTGAGCCTCGGCTAGTAA |
| 15F10.2D6 | 708 | GAAGTACAGCTGGTGGAGTCTGGGGGAGGCTTAGTGAAGCCTGGAGGGTCCCT GAAACTCTCCTGTGCAGCCTCTGGATTCGCTTTCAGTTCCTATGCCATGTCTTGG GTTCGCCAGACTCCGGAAAAGAGGCTGGAGTGGGTCGCAACCATTAGTGATGG TGGTGTTTACACCTACTATACAGACCATGTAAAGGGCCGATTCACCATCTCCAG AGACAATGCCGAGGACAACCTGTACCTGCAAATGAGCCATCTGAAGTCTGAGG ACACAGCCATGTATTATTGTGTGAGAGATGGGGGCTACTGGGGCCAAGGCACC ACTCTCACAGTCTCCTCAGCTAGCACCAAGGGCCCCAGCGTGTTTCCTCTCGCTC CCTGCAGCCGGAGCACATCCGAGAGCACCGCTGCTCTGGGCTGTCTCGTGAAGG ACTACTTCCCTGAACCCGTCACCGTCAGCTGGAATAGCGGCGCCCTGACATCCG GCGTCCACACATTCCCCGCTGTCCTGCAGAGCAGCGGCCTGTACAGCCTGAGCT CCGTGGTCACCGTGCCTAGCAGCAGCCTGGGAACAAAGACCTACACCTGCAAC GTGGACCATAAGCCCTCCAACACCAAGGTGGACAAGCGGGTGGAATCCAAGTA TGGACCCCCTGTCCTCCTTGCCCTGCTCCTGAATTTCTCGGAGGCCCCTCCGTC TTCCTGTTTCCCCCAAGCCCAAGGACACCCTGATGATCTCCCGGACACCCGAA GTCACCTGCGTCGTGGTGGATGTCAGCCAGGAAGATCCCGAGGTGCAGTTCAAC TGGTACGTGGACGGAGTGGAGGTGCATAACGCCAAAACCAAGCCCAGGGAAGA GCAGTTCAACAGCACCTATCGGGTCGTGTCCGTGCTCACCGTCCTGCATCAGGA TTGGCTCAACGGCAAGGAGTACAAGTGCAAGGTGTCCAACAAGGGCCTGCCCT CCTCCATCGAGAAGACCATCTCCAAGGCTAAGGGCCAACCTCGGGAGCCCCAA GTGTATACCCTCCCTCCCAGCCAGGAGGAGATGACCAAGAATCAAGTGAGCCT GACCTGCCTCGTGAAGGGATTTTACCCCTCCGACATCGCTGTGGAATGGGAAAG CAATGGCCAACCTGAGAACAACTACAAGACCACACCCCCCGTGCTGGACTCCG ATGGCTCCTTCTTCCTGTACAGCAGGCTGACCGTGGACAAATCCCGGTGGCAAG AGGGAAACGTGTTCAGCTGCTCCGTGATGCACGAGGCTCTCCACAACCACTACA CCCAGAAGAGCCTCTCCCTGAGCCTCGGCTAGTAA |

Figure 31 cont.

| Antibody | SEQ ID NO: | HC nucleic acid sequence |
|---|---|---|
| 19B5.2E6 | 709 | CAGATCCAACTTGTTCAGAGCGGGCCTGAATTGAAGAAACCAGGCGAGACTGT AAAGATCTCCTGTAAGGCCAGTGGCTATACATTCACCACCTACGCAATGAGCTG GGTCAAGCAGGCACCCGGAAAGGGTCTGAAGTGGATGGGTTGGATAAATACAT ACTCAGGCGTCCCAACCTACGCTGATGATTTGAAGGGGCGCTTTGCCTTTTCTCT TGAAACCTCAGCATCAACCGCCTACTTGCAGATAAATAACCTCAAAAATGAAG ACACCGCTACCTATTTCTGCGCAAGGGGGCCTTATGCTATGGACTACTGGGGCC AGGGCACCTCTGTGACTGTAAGTTCTGCTAGCACCAAGGGCCCCAGCGTGTTTC CTCTCGCTCCCTGCAGCGGAGCACATCCGAGAGCACCGCTGCTCTGGGCTGTC TCGTGAAGGACTACTTCCCTGAACCCGTCACCGTCAGCTGGAATAGCGGCGCCC TGACATCCGGCGTCCACACATTCCCCGCTGTCCTGCAGAGCAGCGGCCTGTACA GCCTGAGCTCCGTGGTCACCGTGCCTAGCAGCAGCCTGGGAACAAAGACCTAC ACCTGCAACGTGGACCATAAGCCCTCCAACACCAAGGTGGACAAGCGGGTGGA ATCCAAGTATGGACCCCCCTGTCCTCCTTGCCCTGCTCCTGAATTTCTCGGAGGC CCCTCCGTCTTCCTGTTTCCCCCAAGCCCAAGGACACCCTGATGATCTCCCGGA CACCCGAAGTCACCTGCGTCGTGGTGGATGTCAGCCAGGAAGATCCCGAGGTG CAGTTCAACTGGTACGTGGACGGAGTGGAGGTGCATAACGCCAAAACCAAGCC CAGGGAAGAGCAGTTCAACAGCACCTATCGGGTCGTGTCCGTGCTCACCGTCCT GCATCAGGATTGGCTCAACGGCAAGGAGTACAAGTGCAAGGTGTCCAACAAGG GCCTGCCCTCCTCCATCGAGAAGACCATCTCCAAGGCTAAGGGCCAACCTCGGG AGCCCCAAGTGTATACCCTCCCTCCCAGCCAGGAGGAGATGACCAAGAATCAA GTGAGCCTGACCTGCCTCGTGAAGGGATTTTACCCCTCCGACATCGCTGTGGAA TGGGAAAGCAATGGCCAACCTGAGAACAACTACAAGACCACACCCCCGTGCT GGACTCCGATGGCTCCTTCTTCCTGTACAGCAGGCTGACCGTGGACAAATCCCG GTGGCAAGAGGGAAACGTGTTCAGCTGCTCCGTGATGCACGAGGCTCTCCACA ACCACTACACCCAGAAGAGCCTCTCCCTGAGCCTCGGCTAGTAA |
| 20D11.2C6 | 710 | GAGGTCCAGCTGCAACAATCTGGACCTGAACTGGTGAAGCCTGGGGCTTCAGT GAAGATATCCTGTAAGGCTTCTGGATACACGTTCACTGACTTCTACATAAACTG GGTGAAGCAGAGCCATGGAAAGAGCCTTGAGTGGATTGGAGATATTAATCCTA AGAATGGTGGTATTAACTACAACCGAAGTTCAAGATCAAGGCCACATTGACT GTAGACAAGTCCTCCAGCACATCCTACATGGACCTCCGCGGCCTGACATCTGAG GACTCTGCAGTCTATTACTGCACCTCAGGCTACGGATTTCCTTACTGGGGCCAA GGGACTCTGGTCACTGTCTCTGCAGCTAGCACCAAGGGCCCCAGCGTGTTTCCT CTCGCTCCCTGCAGCGGAGCACATCCGAGAGCACCGCTGCTCTGGGCTGTCTC GTGAAGGACTACTTCCCTGAACCCGTCACCGTCAGCTGGAATAGCGGCGCCCTG ACATCCGGCGTCCACACATTCCCCGCTGTCCTGCAGAGCAGCGGCCTGTACAGC CTGAGCTCCGTGGTCACCGTGCCTAGCAGCAGCCTGGGAACAAAGACCTACAC CTGCAACGTGGACCATAAGCCCTCCAACACCAAGGTGGACAAGCGGGTGGAAT CCAAGTATGGACCCCCCTGTCCTCCTTGCCCTGCTCCTGAATTTCTCGGAGGCCC CTCCGTCTTCCTGTTTCCCCCAAGCCCAAGGACACCCTGATGATCTCCCGGAC ACCCGAAGTCACCTGCGTCGTGGTGGATGTCAGCCAGGAAGATCCCGAGGTGC AGTTCAACTGGTACGTGGACGGAGTGGAGGTGCATAACGCCAAAACCAAGCCC AGGGAAGAGCAGTTCAACAGCACCTATCGGGTCGTGTCCGTGCTCACCGTCCTG CATCAGGATTGGCTCAACGGCAAGGAGTACAAGTGCAAGGTGTCCAACAAGGG CCTGCCCTCCTCCATCGAGAAGACCATCTCCAAGGCTAAGGGCCAACCTCGGGA GCCCCAAGTGTATACCCTCCCTCCCAGCCAGGAGGAGATGACCAAGAATCAAG TGAGCCTGACCTGCCTCGTGAAGGGATTTTACCCCTCCGACATCGCTGTGGAAT GGGAAAGCAATGGCCAACCTGAGAACAACTACAAGACCACACCCCCGTGCTG GACTCCGATGGCTCCTTCTTCCTGTACAGCAGGCTGACCGTGGACAAATCCCGG TGGCAAGAGGGAAACGTGTTCAGCTGCTCCGTGATGCACGAGGCTCTCCACAA CCACTACACCCAGAAGAGCCTCTCCCTGAGCCTCGGCTAGTAA |

Figure 31 cont.

| Antibody | SEQ ID NO: | HC nucleic acid sequence |
|---|---|---|
| 20H5.A3 | 711 | CAGATCCAGTTGGTACAGTCTGGACCTGAGCTGAAGAAGCCTGGAGAGTCAGT CAAGATCTCCTGCAAGGCTTCTGGTTATGCCTTCACAACCTATGGAATGAGCTG GGTGCAACAGGCTCCAGGAAAGGGTTTAAAGTGGATGGGCTGGGTAAACACCT ACTCTGGAGTGCCAACATGTGCTGATGACTTCAAGGGACGGTTTGCCTTCTCTTT GGAAACCTCTGCCAGCACTGCCTATTTGCAGATCAACAACCTCAGAAATGAGG ACACGGCTACATATTTCTGTGCAAGAGGGCCCTATGCTATGGACTACTGGGGTC AAGGAACCTCAGTCACCGTCTCCTCAGCTAGCACCAAGGGCCCCAGCGTGTTTC CTCTCGCTCCCTGCAGCGGAGCACATCCGAGAGCACCGCTGCTCTGGGCTGTC TCGTGAAGGACTACTTCCCTGAACCCGTCACCGTCAGCTGGAATAGCGGCGCCC TGACATCCGGCGTCCACACATTCCCCGCTGTCCTGCAGAGCAGCGGCCTGTACA GCCTGAGCTCCGTGGTCACCGTGCCTAGCAGCAGCCTGGGAACAAAGACCTAC ACCTGCAACGTGGACCATAAGCCCTCCAACACCAAGGTGGACAAGCGGGTGGA ATCCAAGTATGGACCCCCCTGTCCTCCTTGCCCTGCTCCTGAATTTCTCGGAGGC CCCTCCGTCTTCCTGTTTCCCCCAAGCCCAAGGACACCCTGATGATCTCCCGGA CACCCGAAGTCACCTGCGTCGTGGTGGATGTCAGCCAGGAAGATCCCGAGGTG CAGTTCAACTGGTACGTGGACGGAGTGGAGGTGCATAACGCCAAAACCAAGCC CAGGGAAGAGCAGTTCAACAGCACCTATCGGGTCGTGTCCGTGCTCACCGTCCT GCATCAGGATTGGCTCAACGGCAAGGAGTACAAGTGCAAGGTGTCCAACAAGG GCCTGCCCTCCTCCATCGAGAAGACCATCTCCAAGGCTAAGGGCCAACCTCGGG AGCCCCAAGTGTATACCCTCCCTCCCAGCCAGGAGGAGATGACCAAGAATCAA GTGAGCCTGACCTGCCTCGTGAAGGGATTTTACCCCTCCGACATCGCTGTGGAA TGGGAAAGCAATGGCCAACCTGAGAACAACTACAAGACCACACCCCCGTGCT GGACTCCGATGGCTCCTTCTTCCTGTACAGCAGGCTGACCGTGGACAAATCCCG GTGGCAAGAGGGAAACGTGTTCAGCTGCTCCGTGATGCACGAGGCTCTCCACA ACCACTACACCCAGAAGAGCCTCTCCCTGAGCCTCGGCTAGTAA |
| 23H9.2E4 | 712 | CAGATCCAGTTGGTACAGTCTGGACCTGAGCTGAAGAAGCCTGGAGAGACAGT CAAGATCTCCTGCAAGGCTTCTGGGTATACCTTCACAACCTATGCAATGAGCTG GGTGAAACAGGCTCCAGGAAAGGGTTTAAAGTGGATGGGCTGGATAAACACCT ACTCTGGAGTGCCAACATATGCTGATGACTTCAAGGGACGGTTTGCCTTCTCTT TGGAAACCTCTGCCAGCACTGCCTATTTGCAGATCAACAACCTCAAAAATGAGG ACACGGCTACATATTTCTGTGCAAGAGGGCCCTATGCTATGGACTACTGGGGTC AAGGAACCTCAGTCACCGTCTCCTCAGCTAGCACCAAGGGCCCCAGCGTGTTTC CTCTCGCTCCCTGCAGCGGAGCACATCCGAGAGCACCGCTGCTCTGGGCTGTC TCGTGAAGGACTACTTCCCTGAACCCGTCACCGTCAGCTGGAATAGCGGCGCCC TGACATCCGGCGTCCACACATTCCCCGCTGTCCTGCAGAGCAGCGGCCTGTACA GCCTGAGCTCCGTGGTCACCGTGCCTAGCAGCAGCCTGGGAACAAAGACCTAC ACCTGCAACGTGGACCATAAGCCCTCCAACACCAAGGTGGACAAGCGGGTGGA ATCCAAGTATGGACCCCCCTGTCCTCCTTGCCCTGCTCCTGAATTTCTCGGAGGC CCCTCCGTCTTCCTGTTTCCCCCAAGCCCAAGGACACCCTGATGATCTCCCGGA CACCCGAAGTCACCTGCGTCGTGGTGGATGTCAGCCAGGAAGATCCCGAGGTG CAGTTCAACTGGTACGTGGACGGAGTGGAGGTGCATAACGCCAAAACCAAGCC CAGGGAAGAGCAGTTCAACAGCACCTATCGGGTCGTGTCCGTGCTCACCGTCCT GCATCAGGATTGGCTCAACGGCAAGGAGTACAAGTGCAAGGTGTCCAACAAGG GCCTGCCCTCCTCCATCGAGAAGACCATCTCCAAGGCTAAGGGCCAACCTCGGG AGCCCCAAGTGTATACCCTCCCTCCCAGCCAGGAGGAGATGACCAAGAATCAA GTGAGCCTGACCTGCCTCGTGAAGGGATTTTACCCCTCCGACATCGCTGTGGAA TGGGAAAGCAATGGCCAACCTGAGAACAACTACAAGACCACACCCCCGTGCT GGACTCCGATGGCTCCTTCTTCCTGTACAGCAGGCTGACCGTGGACAAATCCCG GTGGCAAGAGGGAAACGTGTTCAGCTGCTCCGTGATGCACGAGGCTCTCCACA ACCACTACACCCAGAAGAGCCTCTCCCTGAGCCTCGGCTAGTAA |

Figure 31 cont.

| Antibody | SEQ ID NO: | HC nucleic acid sequence |
|---|---|---|
| 2D10-VH0-VL0 | 713 | CAAGTACAGCTCCAGCAATCAGGACCTGAACTTGTTAAGCCAGGTGCAAGCGTCAAAATAAGTTGTAAAGCATCAGGTTACACCTTTACAGACTACTATATCAACTGGGTCAAGCAACGGCCTGGTCAGGGACTTGAATGGATAGGTTGGATCTACCCTGGGTCAAGACACCAAGTACAATGAAAAATTTAAGGGGAAAGCCACTCTGACAGTAGATACTAGCTCAAGTACCGCCTACATGCAGCTCGGCAGCCTCACTTCCGAGGACTCTGCCGTATATTTCTGTGCCAACTACTTCGGGTCTTCTGGGTGGTTCTTTGATGTGTGGGGAACCGGCACCACCGTAACCGTTTCCTCAGCTAGCACCAAGGGCCCCAGCGTGTTTCCTCTCGCTCCCTGCAGCCGGAGCACATCCGAGAGCACCGCTGCTCTGGGCTGTCTCGTGAAGGACTACTTCCCTGAACCCGTCACCGTCAGCTGGAATAGCGGCGCCCTGACATCCGGCGTCCACACATTCCCCGCTGTCCTGCAGAGCAGCGGCCTGTACAGCCTGAGCTCCGTGGTCACCGTGCCTAGCAGCAGCCTGGGAACAAAGACCTACACCTGCAACGTGGACCATAAGCCCTCCAACACCAAGGTGGACAAGCGGGTGGAATCCAAGTATGGACCCCCTGTCCTCCTTGCCCTGCTCCTGAATTTCTCGGAGGCCCCTCCGTCTTCCTGTTTCCCCCAAGCCCAAGGACACCCTGATGATCTCCCGGACACCCGAAGTCACCTGCGTCGTGGTGGATGTCAGCCAGGAAGATCCCGAGGTGCAGTTCAACTGGTACGTGGACGGAGTGGAGGTGCATAACGCCAAAACCAAGCCCAGGGAAGAGCAGTTCAACAGCACCTATCGGGTCGTGTCCGTGCTCACCGTCCTGCATCAGGATTGGCTCAACGGCAAGGAGTACAAGTGCAAGGTGTCCAACAAGGGCCTGCCCTCCTCATCGAGAAGACCATCTCCAAGGCTAAGGGCCAACCTCGGGAGCCCCAAGTGTATACCCTCCCTCCCAGCCAGGAGGAGATGACCAAGAATCAAGTGAGCCTGACCTGCCTCGTGAAGGGATTTTACCCCTCCGACATCGCTGTGGAATGGGAAAGCAATGGCCAACCTGAGAACAACTACAAGACCACACCCCCGTGCTGGACTCCGATGGCTCCTTCTTCCTGTACAGCAGGCTGACCGTGGACAAATCCCGGTGGCAAGAGGGAAACGTGTTCAGCTGCTCCGTGATGCACGAGGCTCTCCACAACCACTACACCCAGAAGAGCCTCTCCCTGAGCCTCGGCTAGTAA |
| 3B11.2G2 | 714 | CAGATCCAGTTGGTACAGTCTGGACCTGAGCTGAAGAAGCCTGGAGAGACAGTCAAGATCTCCTGCAAGACTTCTGGGTATAAATTCAAAACCTATGTAATGAGCTGGGTGAAACAGGCTCCAGGAAAGGCTTTAAAGTGGATGGGCTGGATAAACACCTACTCTGGAGTGCCAACATATGCTGATGACTTCAAGGGACGGTTTGCCTTCTCTTTGGAAACCTCTGCCAGCACTGCCTATTTGGAGATCATCAACCTCAAAAATGAGGACACGGCTACATATTTCTGTGCAAGAGATGGTAATTACGGGGATCCTATGGACTACTGGGGTCAAGGAACCTCAGTCACCGTCTCCTCAGCTAGCACCAAGGGCCCCAGCGTGTTTCCTCTCGCTCCCTGCAGCCGGAGCACATCCGAGAGCACCGCTGCTCTGGGCTGTCTCGTGAAGGACTACTTCCCTGAACCCGTCACCGTCAGCTGGAATAGCGGCGCCCTGACATCCGGCGTCCACACATTCCCCGCTGTCCTGCAGAGCAGCGGCCTGTACAGCCTGAGCTCCGTGGTCACCGTGCCTAGCAGCAGCCTGGGAACAAAGACCTACACCTGCAACGTGGACCATAAGCCCTCCAACACCAAGGTGGACAAGCGGGTGGAATCCAAGTATGGACCCCCTGTCCTCCTTGCCCTGCTCCTGAATTTCTCGGAGGCCCCTCCGTCTTCCTGTTTCCCCCAAGCCCAAGGACACCCTGATGATCTCCCGGACACCCGAAGTCACCTGCGTCGTGGTGGATGTCAGCCAGGAAGATCCCGAGGTGCAGTTCAACTGGTACGTGGACGGAGTGGAGGTGCATAACGCCAAAACCAAGCCCAGGGAAGAGCAGTTCAACAGCACCTATCGGGTCGTGTCCGTGCTCACCGTCCTGCATCAGGATTGGCTCAACGGCAAGGAGTACAAGTGCAAGGTGTCCAACAAGGGCCTGCCCTCCTCATCGAGAAGACCATCTCCAAGGCTAAGGGCCAACCTCGGGAGCCCCAAGTGTATACCCTCCCTCCCAGCCAGGAGGAGATGACCAAGAATCAAGTGAGCCTGACCTGCCTCGTGAAGGGATTTTACCCCTCCGACATCGCTGTGGAATGGGAAAGCAATGGCCAACCTGAGAACAACTACAAGACCACACCCCCGTGCTGGACTCCGATGGCTCCTTCTTCCTGTACAGCAGGCTGACCGTGGACAAATCCCGGTGGCAAGAGGGAAACGTGTTCAGCTGCTCCGTGATGCACGAGGCTCTCCACAACCACTACACCCAGAAGAGCCTCTCCCTGAGCCTCGGCTAGTAA |

Figure 31 cont.

| Antibody | SEQ ID NO: | HC nucleic acid sequence |
|---|---|---|
| 7D8.2D8 | 715 | GAAGTGCAGCTGGTGGAGTCTGGGGGAGGCTTAGTGAAGCCTGGAGGGTCCCT GAAACTCTCCTGTGCAGCCTCTGGATTCACTTTCAGTAGCTATGCCATGTCTTGG GTTCGCCAGACTCCGGAAAAGAGGCTGGAGTGGGTCGCAACCATCAGTGATGG TGGTATTTACACCTACTATCCAGACAATGTAAAGGGCCGATTCACCATTTCCAG AGACAATGCCAAGAACAACCTGTTCCTGCAAATGAGCCATCTGAAGTCTGAGG ATACAGCCATGTATTACTGTGTAAGAGATGGGGGCTACTGGGGCCAAGGCACC ACTCTCACAGTCTCCTCAGCTAGCACCAAGGGCCCCAGCGTGTTCCTCTCGCTC CCTGCAGCCGGAGCACATCCGAGAGCACCGCTGCTCTGGGCTGTCTCGTGAAGG ACTACTTCCCTGAACCCGTCACCGTCAGCTGGAATAGCGGCGCCCTGACATCCG GCGTCCACACATTCCCCGCTGTCCTGCAGAGCAGCGGCCTGTACAGCCTGAGCT CCGTGGTCACCGTGCCTAGCAGCAGCCTGGGAACAAAGACCTACACCTGCAAC GTGGACCATAAGCCCTCCAACACCAAGGTGGACAAGCGGGTGGAATCCAAGTA TGGACCCCCCTGTCCTCCTTGCCCTGCTCCTGAATTTCTCGGAGGCCCCTCCGTC TTCCTGTTTCCCCCCAAGCCCAAGGACACCCTGATGATCTCCCGGACACCCGAA GTCACCTGCGTCGTGGTGGATGTCAGCCAGGAAGATCCCGAGGTGCAGTTCAAC TGGTACGTGGACGGAGTGGAGGTGCATAACGCCAAAACCAAGCCCAGGGAAGA GCAGTTCAACAGCACCTATCGGGTCGTGTCCGTGCTCACCGTCCTGCATCAGGA TTGGCTCAACGGCAAGGAGTACAAGTGCAAGGTGTCCAACAAGGGCCTGCCCT CCTCCATCGAGAAGACCATCTCCAAGGCTAAGGGCCAACCTCGGGAGCCCCAA GTGTATACCCTCCCTCCCAGCCAGGAGGAGATGACCAAGAATCAAGTGAGCCT GACCTGCCTCGTGAAGGGATTTTACCCCTCCGACATCGCTGTGGAATGGGAAAG CAATGGCCAACCTGAGAACAACTACAAGACCACACCCCCCGTGCTGGACTCCG ATGGCTCCTTCTTCCTGTACAGCAGGCTGACCGTGGACAAATCCCGGTGGCAAG AGGGAAACGTGTTCAGCTGCTCCGTGATGCACGAGGCTCTCCACAACCACTACA CCCAGAAGAGCCTCTCCCTGAGCCTCGGCTAGTAA |
| mTB001 (mIMT001) | 716 | CAGATCCAACTTGTGCAGTCAGGTCCAGAATTGAAGAAGCCTGGTGAGACCGT CAAGATTTCCTGTAAGGCCTCTGGTTATACTTTTACCAACTATGGCATGAATTGG GTCAAGCAGGCACCTGGGAAGGGTTTGAAATGGATGGGGTGGATAAATACCAA CACAGGGGAACCAACTTACGTTGAAGAGTTTAAGGGTCGTTTTGCATTCAGTCT TGAGACTTCTGCAAGCACAGCTTACCTCCAAATTAACAATCTCAAAAATGAAGA TACTGCTACATATTTCTGTGCTCCTTATGATAATTTTTCGCCTACTGGGGACAG GGAACTCTGGTCACCGTCTCAGCAGCTAAGACTACTCCTCCCAGTGTCTACCCC CTGGCCCCCGTGTGCGGCGACACAACAGGCTCCTCCGTGACACTGGGCTGCCTG GTGAAAGGCTACTTCCCCGAGCCCGTGACACTGACATGGAACTCCGGCTCCCTG TCCTCCGGCGTGCACACATTCCCCGCCGTGCTGCAGTCCGACCTGTACACACTG TCCTCCTCCGTGACAGTGACATCCTCCACATGGCCCTCCCAGTCCATCACATGC AACGTGGCCCACCCCGCCTCCTCCACAAAAGTGGACAAAAAAATCGAGCCCAG GGGCCCCACAATCAAACCCTGCCCCCCTGCAAATGCCCCGCCCCAACGCCGC CGGCGGCCCCTCCGTGTTCATCTTCCCCCCAAAATCAAAGACGTGCTGATGAT CTCCCTGTCCCCCATCGTGACATGCGTGGTGGTGGACGTGTCCGAGGACGACCC CGACGTGCAGATCTCCTGGTTCGTGAACAACGTGGAGGTGCACACAGCCCAGA CACAGACACACAGGGAGGACTACAACTCCACACTGAGGGTGGTGTCCGCCCTG CCCATCCAGCACCAGGACTGGATGTCCGGCAAAGAGTTCAAATGCAAAGTGAA CAACAAAGACCTGGGCGCCCCCATCGAGAGGACAATCTCCAAACCCAAAGGCT CCGTGAGGGCCCCCCAGGTGTACGTGCTGCCCCCCCCGAGGAGGAGATGACA AAAAAACAGGTGACACTGACATGCATGGTGACAGACTTCATGCCCGAGGACAT CTACGTGGAGTGGACAAACAACGGCAAAACAGAGCTGAACTACAAAAACACA GAGCCCGTGCTGGACTCCGACGGCTCCTACTTCATGTACTCCAAACTGAGGGTG GAGAAAAAAACTGGGTGGAGAGGAACTCCTACTCCTGCTCCGTGGTGCACGA GGGCCTGCACAACCACCACAACAAAATCCTTCTCCAGGACACCCGGCAAAT AGTAA |

| Antibody | SEQ ID NO: | HC nucleic acid sequence |
|---|---|---|
| 4A11.2B5 | 717 | CAGGTACAACTTCAGCAGAGCGGTCCAGAACTTGTGAAGCCCGGTGCTAGTGTC AAAATATCTTGCAAAGCAAGTGGTTATTCCTTCACCAACTATTACATACACTGG GTAAAACAACGTCCAGGGCAAGGACTCGAATGGATTGGTTGGATCTACCCCGG CAGCGGCAACACTAACTACAACGAGAAGTTTAAAGGCAAAGCTACTCTCACAG CAGACACTTCTAGCAGTACAACAAATATGCAGTTGTCCTCTCTGACTTCCGAAG ACAGCGCCGTCTATTACTGTTCTACTGCACCCGGAGGTTTTGACGTCTGGGGTTC CGGCACCACAGTTACCGTTAGTTCCGCTAGCACCAAGGGCCCCAGCGTGTTTCC TCTCGCTCCCTGCAGCCGGAGCACATCCGAGAGCACCGCTGCTCTGGGCTGTCT CGTGAAGGACTACTTCCCTGAACCCGTCACCGTCAGCTGGAATAGCGGCGCCCT GACATCCGGCGTCCACACATTCCCCGCTGTCCTGCAGAGCAGCGGCCTGTACAG CCTGAGCTCCGTGGTCACCGTGCCTAGCAGCAGCCTGGGAACAAAGACCTACA CCTGCAACGTGGACCATAAGCCCTCCAACACCAAGGTGGACAAGCGGGTGGAA TCCAAGTATGGACCCCCCTGTCCTCCTTGCCCTGCTCCTGAATTTCTCGGAGGCC CCTCCGTCTTCCTGTTTCCCCCCAAGCCCAAGGACACCCTGATGATCTCCCGGAC ACCCGAAGTCACCTGCGTCGTGGTGGATGTCAGCCAGGAAGATCCCGAGGTGC AGTTCAACTGGTACGTGGACGGAGTGGAGGTGCATAACGCCAAAACCAAGCCC AGGGAAGAGCAGTTCAACAGCACCTATCGGGTCGTGTCCGTGCTCACCGTCCTG CATCAGGATTGGCTCAACGGCAAGGAGTACAAGTGCAAGGTGTCCAACAAGGG CCTGCCCTCCTCCATCGAGAAGACCATCTCCAAGGCTAAGGGCCAACCTCGGGA GCCCCAAGTGTATACCCTCCCTCCCAGCCAGGAGGAGATGACCAAGAATCAAG TGAGCCTGACCTGCCTCGTGAAGGGATTTTACCCCTCCGACATCGCTGTGGAAT GGGAAAGCAATGGCCAACCTGAGAACAACTACAAGACCACACCCCCCGTGCTG GACTCCGATGGCTCCTTCTTCCTGTACAGCAGGCTGACCGTGGACAAATCCCGG TGGCAAGAGGGAAACGTGTTCAGCTGCTCCGTGATGCACGAGGCTCTCCACAA CCACTACACCCAGAAGAGCCTCTCCCTGAGCCTCGGCTAGTAA |
| 4A11.H1L1 (IMT006b) | 718 | CAGGTGCAGCTGGTGCAATCAGGAGCCGAAGTTAAGAAGCCTGGCGCCAGCGT CAAGGTCTCATGTAAAGCCTCCGGTTACAGTTTCACCAACTACTATATGCACTG GGTTAGGCAAGCACCAGGCCAGGGGCTTGAGTGGATGGGATGGATCTATCCAG GGAGCGGTAACACCAATTACAATGAGAAGTTTCAAGGGCGCGTAACCATGACA GCAGATACCAGTATAAGCACCGCCTATATGGAACTCTCTCGGTTGAGATCCGAT GATACCGCTGTTTATTACTGCTCTACCGCACCTGGTGGTTTCGACGTTTGGGGCC AAGGTACTACAGTGACCGTATCATCAGCTAGCACCAAGGGCCCCAGCGTGTTTC CTCTCGCTCCCTGCAGCCGGAGCACATCCGAGAGCACCGCTGCTCTGGGCTGTC TCGTGAAGGACTACTTCCCTGAACCCGTCACCGTCAGCTGGAATAGCGGCGCCC TGACATCCGGCGTCCACACATTCCCCGCTGTCCTGCAGAGCAGCGGCCTGTACA GCCTGAGCTCCGTGGTCACCGTGCCTAGCAGCAGCCTGGGAACAAAGACCTAC ACCTGCAACGTGGACCATAAGCCCTCCAACACCAAGGTGGACAAGCGGGTGGA ATCCAAGTATGGACCCCCCTGTCCTCCTTGCCCTGCTCCTGAATTTCTCGGAGGC CCCTCCGTCTTCCTGTTTCCCCCCAAGCCCAAGGACACCCTGATGATCTCCCGGA CACCCGAAGTCACCTGCGTCGTGGTGGATGTCAGCCAGGAAGATCCCGAGGTG CAGTTCAACTGGTACGTGGACGGAGTGGAGGTGCATAACGCCAAAACCAAGCC CAGGGAAGAGCAGTTCAACAGCACCTATCGGGTCGTGTCCGTGCTCACCGTCCT GCATCAGGATTGGCTCAACGGCAAGGAGTACAAGTGCAAGGTGTCCAACAAGG GCCTGCCCTCCTCCATCGAGAAGACCATCTCCAAGGCTAAGGGCCAACCTCGGG AGCCCCAAGTGTATACCCTCCCTCCCAGCCAGGAGGAGATGACCAAGAATCAA GTGAGCCTGACCTGCCTCGTGAAGGGATTTTACCCCTCCGACATCGCTGTGGAA TGGGAAAGCAATGGCCAACCTGAGAACAACTACAAGACCACACCCCCCGTGCT GGACTCCGATGGCTCCTTCTTCCTGTACAGCAGGCTGACCGTGGACAAATCCCG GTGGCAAGAGGGAAACGTGTTCAGCTGCTCCGTGATGCACGAGGCTCTCCACA ACCACTACACCCAGAAGAGCCTCTCCCTGAGCCTCGGCTAGTAA |

Figure 31 cont.

| Antibody | SEQ ID NO: | HC nucleic acid sequence |
|---|---|---|
| 4A11.H4L2 (IMT006c) | 719 | CAGGTGCAACTGGTCCAGTCTGGGGCCGAGGTCAAAAAGCCTGGAGCCTCCGT<br>CAAAGTGTCATGTAAAGCCTCAGGGTATAGTTTCACCAACTACTATATACATTG<br>GGTCAGACAAGCCCCAGGCCAGCGTCTTGAGTGGATGGGATGGATTTATCCCG<br>GATCAGGGAATACAAACTATAACGAGAAATTTCAAGGCAGAGTTACTCTCACT<br>GCCGATACCTCTGCAAGTACTACCTATATGGAGCTCTCCAGTCTCAGAAGCGAA<br>GACACAGCAGTATATTACTGTAGCACCGCCCCAGGCGGGTTTGACGTGTGGGGC<br>CAAGGCACTACTGTAACCGTTAGCTCAGCTAGCACCAAGGGCCCCAGCGTGTTT<br>CCTCTCGCTCCCTGCAGCCGGAGCACATCGAGAGCACCGCTGCTCTGGGCTGT<br>CTCGTGAAGGACTACTTCCCTGAACCCGTCACCGTCAGCTGGAATAGCGGCGCC<br>CTGACATCCGGCGTCCACACATTCCCCGCTGTCCTGCAGAGCAGCGGCCTGTAC<br>AGCCTGAGCTCCGTGGTCACCGTGCCTAGCAGCAGCCTGGGAACAAAGACCTA<br>CACCTGCAACGTGGACCATAAGCCCTCCAACACCAAGGTGGACAAGCGGGTGG<br>AATCCAAGTATGGACCCCCCTGTCCTCCTTGCCCTGCTCCTGAATTTCTCGGAGG<br>CCCCTCCGTCTTCCTGTTTCCCCCCAAGCCCAAGGACACCCTGATGATCTCCCGG<br>ACACCCGAAGTCACCTGCGTCGTGGTGGATGTCAGCCAGGAAGATCCCGAGGT<br>GCAGTTCAACTGGTACGTGGACGGAGTGGAGGTGCATAACGCCAAAACCAAGC<br>CCAGGGAAGAGCAGTTCAACAGCACCTATCGGGTCGTGTCCGTGCTCACCGTCC<br>TGCATCAGGATTGGCTCAACGGCAAGGAGTACAAGTGCAAGGTGTCCAACAAG<br>GGCCTGCCCTCCTCCATCGAGAAGACCATCTCCAAGGCTAAGGGCCAACCTCGG<br>GAGCCCCAAGTGTATACCCTCCCTCCCAGCCAGGAGGAGATGACCAAGAATCA<br>AGTGAGCCTGACCTGCCTCGTGAAGGGATTTTACCCCTCCGACATCGCTGTGGA<br>ATGGGAAAGCAATGGCCAACCTGAGAACAACTACAAGACCACACCCCCCGTGC<br>TGGACTCCGATGGCTCCTTCTTCCTGTACAGCAGGCTGACCGTGGACAAATCCC<br>GGTGGCAAGAGGGAAACGTGTTCAGCTGCTCCGTGATGCACGAGGCTCTCCAC<br>AACCACTACACCCAGAAGAGCCTCTCCCTGAGCCTCGGCTAGTAA |
| 4G2.2G6 | 720 | CAAATACAGCTCGTGCAGTCTGGTCCCGATTTGAAGAAGCCTGGAGAAACCGT<br>AAAGATAAGCTGTAAGGCTAGTGGTTACACTTTCACAACATACGTTATGTCATG<br>GGTTAAACAGGCTCCTGGAAAAGACCTTAAATGGATGGGACGATTTGACTTTTCTCT<br>ATAGCGGTGTCCCAACTTACGCTGACGATTTTAAGGGACGATTTGACTTTTCTCT<br>CGAAACTTCTGCCAACACAGCTTTTTTGCAGATCAACAATCTCAAGAATGAAGA<br>CACCGCAACCTATTTCTGCACTCGAGATGGGAACGACGGGGATGCAATGGATA<br>ACTGGGGACAAGGCACATCAGTTACCGTGAGCTCTGCTAGCACCAAGGGCCCC<br>AGCGTGTTTCCTCTCGCTCCCTGCAGCCGGAGCACATCGAGAGCACCGCTGCT<br>CTGGGCTGTCTCGTGAAGGACTACTTCCCTGAACCCGTCACCGTCAGCTGGAAT<br>AGCGGCGCCCTGACATCCGGCGTCCACACATTCCCCGCTGTCCTGCAGAGCAGC<br>GGCCTGTACAGCCTGAGCTCCGTGGTCACCGTGCCTAGCAGCAGCCTGGGAACA<br>AAGACCTACACCTGCAACGTGGACCATAAGCCCTCCAACACCAAGGTGGACAA<br>GCGGGTGGAATCCAAGTATGGACCCCCCTGTCCTCCTTGCCCTGCTCCTGAATTT<br>CTCGGAGGCCCCTCCGTCTTCCTGTTTCCCCCCAAGCCCAAGGACACCCTGATG<br>ATCTCCCGGACACCCGAAGTCACCTGCGTCGTGGTGGATGTCAGCCAGGAAGAT<br>CCCGAGGTGCAGTTCAACTGGTACGTGGACGGAGTGGAGGTGCATAACGCCAA<br>AACCAAGCCCAGGGAAGAGCAGTTCAACAGCACCTATCGGGTCGTGTCCGTGC<br>TCACCGTCCTGCATCAGGATTGGCTCAACGGCAAGGAGTACAAGTGCAAGGTG<br>TCCAACAAGGGCCTGCCCTCCTCCATCGAGAAGACCATCTCCAAGGCTAAGGGC<br>CAACCTCGGGAGCCCCAAGTGTATACCCTCCCTCCCAGCCAGGAGGAGATGAC<br>CAAGAATCAAGTGAGCCTGACCTGCCTCGTGAAGGGATTTTACCCCTCCGACAT<br>CGCTGTGGAATGGGAAAGCAATGGCCAACCTGAGAACAACTACAAGACCACAC<br>CCCCCGTGCTGGACTCCGATGGCTCCTTCTTCCTGTACAGCAGGCTGACCGTGG<br>ACAAATCCCGGTGGCAAGAGGGAAACGTGTTCAGCTGCTCCGTGATGCACGAG<br>GCTCTCCACAACCACTACACCCAGAAGAGCCTCTCCCTGAGCCTCGGCTAGTAA |

Figure 31 cont.

| Antibody | SEQ ID NO: | HC nucleic acid sequence |
|---|---|---|
| 6B3.2D3 | 721 | CAGGTGCAGCTGAAGCAGTCAGGACCTGGCCTAGTGCAGCCCTCACAGAGCCTGTCCATCACCTGCACAGTCTCTGGTTTCTCATTAACTAGTTATGGTGTACACTGGGTTCGCCAGCCTCCAGGAAAGGGTCTGGAGTGGCTGGGAGTGATATGGAGTGGTGGAAGCACAGACTATAATGCTGCTTTCATATCCAGACTGAGCATCAGTAAGGACAACTCCAAGAGCCAAGTTTTCTTTAAAATGAACAGTCTGCAAGCTGATGACACTGCCATATACTACTGTGCCAAAGGGCCTTATGATTACGACTTAGGCTGGTTTGCTTACTGGGGCCAAGGGACTCTGGTCACTGTCTCTGCAGCTAGCACCAAGGGCCCCAGCGTGTTTCCTCTCGCTCCCTGCAGCCGGAGCACATCCGAGAGCACCGCTGCTCTGGGCTGTCTCGTGAAGGACTACTTCCCTGAACCCGTCACCGTCAGCTGGAATAGCGGCGCCCTGACATCCGGCGTCCACACATTCCCCGCTGTCCTGCAGAGCAGCGGCCTGTACAGCCTGAGCTCCGTGGTCACCGTGCCTAGCAGCAGCCTGGGAACAAAGACCTACACCTGCAACGTGGACCATAAGCCCTCCAACACCAAGGTGGACAAGCGGGTGGAATCCAAGTATGGACCCCCCTGTCCTCCTTGCCCTGCTCCTGAATTTCTCGGAGGCCCCTCCGTCTTCCTGTTTCCCCCCAAGCCCAAGGACACCCTGATGATCTCCCGGACACCCGAAGTCACCTGCGTCGTGGTGGATGTCAGCCAGGAAGATCCCGAGGTGCAGTTCAACTGGTACGTGGACGGAGTGGAGGTGCATAACGCCAAAACCAAGCCCAGGGAAGAGCAGTTCAACAGCACCTATCGGGTCGTGTCCGTGCTCACCGTCCTGCATCAGGATTGGCTCAACGGCAAGGAGTACAAGTGCAAGGTGTCCAACAAGGGCCTGCCCTCCTCCATCGAGAAGACCATCTCCAAGGCTAAGGGCCAACCTCGGGAGCCCCAAGTGTATACCCTCCCTCCCAGCCAGGAGGAGATGACCAAGAATCAAGTGAGCCTGACCTGCCTCGTGAAGGGATTTTACCCCTCCGACATCGCTGTGGAATGGGAAAGCAATGGCCAACCTGAGAACAACTACAAGACCACACCCCCGTGCTGGACTCCGATGGCTCCTTCTTCCTGTACAGCAGGCTGACCGTGGACAAATCCCGGTGGCAAGAGGGAAACGTGTTCAGCTGCTCCGTGATGCACGAGGCTCTCCACAACCACTACACCCAGAAGAGCCTCTCCCTGAGCCTCGGCTAGTAA |
| 6H6.2D6 | 722 | CAGATCCAGCTGGTGCAGTCCGGCCCCGAGCTGAAGAAGCCCGGCGAGACTGTGAAGATCTCCTGCAAGGCCTCCGGCTACACCTTCACCACCTACGGCATGTCCTGGGTGAAGCAGGCCCCCGGCAAGGGCCTGAAGTGGATGGCCTGGATCAACACCCTACTCCGGCGTGCCCACCTACGCCGACGACTTCAAGGGCAGGTTCGCCTTCTCCCTGGAGACTTCCGCCTCCACCGCCTACCTGCAGATCAACAACCTGACCAACGAGGACACCGCCACCTACTTCTGCGCCAGGGGCCCCTACGCCATGGACTACTGGGGCCAGGGCACCTCCGTGACCGTGTCCTCCGCTAGCACCAAGGGCCCCAGCGTGTTTCCTCTCGCTCCCTGCAGCCGGAGCACATCCGAGAGCACCGCTGCTCTGGGCTGTCTCGTGAAGGACTACTTCCCTGAACCCGTCACCGTCAGCTGGAATAGCGGCGCCCTGACATCCGGCGTCCACACATTCCCCGCTGTCCTGCAGAGCAGCGGCCTGTACAGCCTGAGCTCCGTGGTCACCGTGCCTAGCAGCAGCCTGGGAACAAAGACCTACACCTGCAACGTGGACCATAAGCCCTCCAACACCAAGGTGGACAAGCGGGTGGAATCCAAGTATGGACCCCCCTGTCCTCCTTGCCCTGCTCCTGAATTTCTCGGAGGCCCCTCCGTCTTCCTGTTTCCCCCAAGCCCAAGGACACCCTGATGATCTCCCGGACACCCGAAGTCACCTGCGTCGTGGTGGATGTCAGCCAGGAAGATCCCGAGGTGCAGTTCAACTGGTACGTGGACGGAGTGGAGGTGCATAACGCCAAAACCAAGCCCAGGGAAGAGCAGTTCAACAGCACCTATCGGGTCGTGTCCGTGCTCACCGTCCTGCATCAGGATTGGCTCAACGGCAAGGAGTACAAGTGCAAGGTGTCCAACAAGGGCCTGCCCTCCTCCATCGAGAAGACCATCTCCAAGGCTAAGGGCCAACCTCGGGAGCCCCAAGTGTATACCCTCCCTCCCAGCCAGGAGGAGATGACCAAGAATCAAGTGAGCCTGACCTGCCTCGTGAAGGGATTTTACCCCTCCGACATCGCTGTGGAATGGGAAAGCAATGGCCAACCTGAGAACAACTACAAGACCACACCCCCGTGCTGGACTCCGATGGCTCCTTCTTCCTGTACAGCAGGCTGACCGTGGACAAATCCCGGTGGCAAGAGGGAAACGTGTTCAGCTGCTCCGTGATGCACGAGGCTCTCCACAACCACTACACCCAGAAGAGCCTCTCCCTGAGCCTCGGCTAGTAA |

Figure 31 cont.

| Antibody | SEQ ID NO: | HC nucleic acid sequence |
|---|---|---|
| 9H2.2H10 | 723 | CAGGTCCAGCTGCAGCAGCCTGGGGCTGAACTGGTGGGGCCTGGGTCTTCAGTG<br>AAGCTGTCCTGCAAGGCTTCTGGCTACACCTTCACCAACTACTGGATACATTGG<br>GTGAAGCAGAGGCCTCTACAAGGCCTTGAATGGATTGGTAACATTGACCCTTCT<br>GATAGTGAAACTCACTACAATCAAAAGTTCAAGGACAAGGCCACATTGACTGT<br>AGACAAATCCTCCAGCACAGCCTACATGCAACTCAGCAGCCTGACATCTGAGG<br>ACTCTGCGGTCTATTACTGTGCAAGACATGGTTACTACGACTACTGGGGCCAAG<br>GCACCACTCTCACAGTCTCCTCAGCTAGCACCAAGGGCCCCAGCGTGTTTCCTC<br>TCGCTCCCTGCAGCCGGAGCACATCCGAGAGCACCGCTGCTCTGGGCTGTCTCG<br>TGAAGGACTACTTCCCTGAACCCGTCACCGTCAGCTGGAATAGCGGCGCCCTGA<br>CATCCGGCGTCCACACATTCCCCGCTGTCCTGCAGAGCAGCGGCCTGTACAGCC<br>TGAGCTCCGTGGTCACCGTGCCTAGCAGCAGCCTGGGAACAAAGACCTACACCT<br>GCAACGTGGACCATAAGCCCTCCAACACCAAGGTGGACAAGCGGGTGGAATCC<br>AAGTATGGACCCCCCTGTCCTCCTTGCCCTGCTCCTGAATTTCTCGGAGGCCCCT<br>CCGTCTTCCTGTTTCCCCCAAGCCCAAGGACACCCTGATGATCTCCCGGACAC<br>CCGAAGTCACCTGCGTCGTGGTGGATGTCAGCCAGGAAGATCCCGAGGTGCAG<br>TTCAACTGGTACGTGGACGGAGTGGAGGTGCATAACGCCAAAACCAAGCCCAG<br>GGAAGAGCAGTTCAACAGCACCTATCGGGTCGTGTCCGTGCTCACCGTCCTGCA<br>TCAGGATTGGCTCAACGGCAAGGAGTACAAGTGCAAGGTGTCCAACAAGGGCC<br>TGCCCTCCTCCATCGAGAAGACCATCTCCAAGGCTAAGGGCCAACCTCGGGAGC<br>CCCAAGTGTATACCCTCCCTCCCAGCCAGGAGGAGATGACCAAGAATCAAGTG<br>AGCCTGACCTGCCTCGTGAAGGGATTTTACCCCTCCGACATCGCTGTGGAATGG<br>GAAAGCAATGGCCAACCTGAGAACAACTACAAGACCACACCCCCCGTGCTGGA<br>CTCCGATGGCTCCTTCTTCCTGTACAGCAGGCTGACCGTGGACAAATCCCGGTG<br>GCAAGAGGGAAACGTGTTCAGCTGCTCCGTGATGCACGAGGCTCTCCACAACC<br>ACTACACCCAGAAGAGCCTCTCCCTGAGCCTCGGCTAGTAA |
| 13G4.2F8 | 724 | CAGGTCCAGCTGCAGCAGCCTGGGGCTGAGCTGGTAAAGCCTGGGGCTTCAGT<br>GAAGTTGTCCTGCAAGGCTTCTGGCTACACTTTCACCAGCTACTGGATGCACTG<br>GGTGAAGCAGAGGCCTGGACAAGGCCTTGAGTGGATTGGAATGATTCATCCTA<br>ACAGTGGTAGTACTGAGTACAATGAGAAGTTCAAGAACAAGGCCACACTGAAT<br>GTAGACAAATCCTCCAGTACAGCCTACATACAACTCAGCAGCCTGACATCTGAG<br>GACTCTGCGGTCTATTACTGTACAAGATGGGGGATTTATTACTACGCGAGGGAC<br>TACTGGGGCCAAGGCACCACTCTCACAGTCTCCTCAGCTAGCACCAAGGGCCCC<br>AGCGTGTTTCCTCTCGCTCCCTGCAGCCGGAGCACATCCGAGAGCACCGCTGCT<br>CTGGGCTGTCTCGTGAAGGACTACTTCCCTGAACCCGTCACCGTCAGCTGGAAT<br>AGCGGCGCCCTGACATCCGGCGTCCACACATTCCCCGCTGTCCTGCAGAGCAGC<br>GGCCTGTACAGCCTGAGCTCCGTGGTCACCGTGCCTAGCAGCAGCCTGGGAACA<br>AAGACCTACACCTGCAACGTGGACCATAAGCCCTCCAACACCAAGGTGGACAA<br>GCGGGTGGAATCCAAGTATGGACCCCCCTGTCCTCCTTGCCCTGCTCCTGAATTT<br>CTCGGAGGCCCCTCCGTCTTCCTGTTTCCCCCAAGCCCAAGGACACCCTGATG<br>ATCTCCCGGACACCCGAAGTCACCTGCGTCGTGGTGGATGTCAGCCAGGAAGAT<br>CCCGAGGTGCAGTTCAACTGGTACGTGGACGGAGTGGAGGTGCATAACGCCAA<br>AACCAAGCCCAGGGAAGAGCAGTTCAACAGCACCTATCGGGTCGTGTCCGTGC<br>TCACCGTCCTGCATCAGGATTGGCTCAACGGCAAGGAGTACAAGTGCAAGGTG<br>TCCAACAAGGGCCTGCCCTCCTCCATCGAGAAGACCATCTCCAAGGCTAAGGGC<br>CAACCTCGGGAGCCCCAAGTGTATACCCTCCCTCCCAGCCAGGAGGAGATGAC<br>CAAGAATCAAGTGAGCCTGACCTGCCTCGTGAAGGGATTTTACCCCTCCGACAT<br>CGCTGTGGAATGGGAAAGCAATGGCCAACCTGAGAACAACTACAAGACCACAC<br>CCCCCGTGCTGGACTCCGATGGCTCCTTCTTCCTGTACAGCAGGCTGACCGTGG<br>ACAAATCCCGGTGGCAAGAGGGAAACGTGTTCAGCTGCTCCGTGATGCACGAG<br>GCTCTCCACAACCACTACACCCAGAAGAGCCTCTCCCTGAGCCTCGGCTAGTAA |

Figure 31 cont.

| Antibody | SEQ ID NO: | HC nucleic acid sequence |
|---|---|---|
| 13H12.2F8 | 725 | CAGATCCAGCTGGTCCAATCAGGACCCGAACTGAAAAAACCAGGCGAGACAGT CAAAATCAGCTGTAAGGCCTCAGGCTACACTTTCACAACCTACGGGATGTCATG GGTAAAGCAAGCTCCTGGCAAGGGGCTGAAATGGATGGGTTGGATCAACACAT ACTCTGGAGTGCCCACCTACGCTGACGACTTTAAGGGTAGATTCGCATTTAGCC TGGAAACAAGTGCCAGTACAGCCTACCTCCAGATAAACAACTTGAAAAACGAG GATACCGCAACCTATTTTTGCGCCGTCCCCTACGAGTACGACGGTGCCTATTGG GGTCAGGGTACACTCGTAACAGTTTCCGCCGCTAGCACCAAGGGCCCCAGCGTG TTTCCTCTCGCTCCCTGCAGCCGGAGCACATCCGAGAGCACCGCTGCTCTGGGC TGTCTCGTGAAGGACTACTTCCCTGAACCCGTCACCGTCAGCTGGAATAGCGGC GCCCTGACATCCGGCGTCCACACATTCCCCGCTGTCCTGCAGAGCAGCGGCCTG TACAGCCTGAGCTCCGTGGTCACCGTGCCTAGCAGCAGCCTGGGAACAAAGAC CTACACCTGCAACGTGGACCATAAGCCCTCCAACACCAAGGTGGACAAGCGGG TGGAATCCAAGTATGGACCCCCCTGTCCTCCTTGCCCTGCTCCTGAATTTCTCGG AGGCCCCTCCGTCTTCCTGTTTCCCCCAAGCCCAAGGACACCCTGATGATCTCC CGGACACCCGAAGTCACCTGCGTCGTGGTGGATGTCAGCCAGGAAGATCCCGA GGTGCAGTTCAACTGGTACGTGGACGGAGTGGAGGTGCATAACGCCAAAACCA AGCCCAGGGAAGAGCAGTTCAACAGCACCTATCGGGTCGTGTCCGTGCTCACC GTCCTGCATCAGGATTGGCTCAACGGCAAGGAGTACAAGTGCAAGGTGTCCAA CAAGGGCCTGCCCTCCTCCATCGAGAAGACCATCTCCAAGGCTAAGGGCCAAC CTCGGGAGCCCCAAGTGTATACCCTCCCTCCCAGCCAGGAGGAGATGACCAAG AATCAAGTGAGCCTGACCTGCCTCGTGAAGGGATTTTACCCCTCCGACATCGCT GTGGAATGGGAAAGCAATGGCCAACCTGAGAACAACTACAAGACCACACCCCC CGTGCTGGACTCCGATGGCTCCTTCTTCCTGTACAGCAGGCTGACCGTGGACAA ATCCCGGTGGCAAGAGGGAAACGTGTTCAGCTGCTCCGTGATGCACGAGGCTCT CCACAACCACTACACCCAGAAGAGCCTCTCCCTGAGCCTCGGCTAGTAA |
| 15G7.2A7 | 726 | GAGGTCCAGCTGCAACAATCTGGACCTGAGCTGGTGAAGCCTGGGGCTTCAGT GAAGATATCCTGTAAGGCTTCTGGATACACGTTCACTGACTACTACATGAACTG GGTGAAGCAGAGCCATGGAAAGAGCCTTGAGTGGATTGGAGATATTAATCCTA ACAATGGTGGTACTAACTACAACCAGAAGTTCAAGGGCAAGGCCACATTGACT GTAGACAAGTCCTCCAGCACAGCCTACATGGAAGCTCCGCAGCCTGACATCTGAG GACTCTGCAGTCTATTACTGCACCTCAGGCTACGGGTTTCCTTACTGGGGCCAG GGGACTCTGGTCACTGTCTCTGCAGCTAGCACCAAGGGCCCCAGCGTGTTTCCT CTCGCTCCCTGCAGCCGGAGCACATCCGAGAGCACCGCTGCTCTGGGCTGTCTC GTGAAGGACTACTTCCCTGAACCCGTCACCGTCAGCTGGAATAGCGGCGCCCTG ACATCCGGCGTCCACACATTCCCCGCTGTCCTGCAGAGCAGCGGCCTGTACAGC CTGAGCTCCGTGGTCACCGTGCCTAGCAGCAGCCTGGGAACAAAGACCTACAC CTGCAACGTGGACCATAAGCCCTCCAACACCAAGGTGGACAAGCGGGTGGAAT CCAAGTATGGACCCCCCTGTCCTCCTTGCCCTGCTCCTGAATTTCTCGGAGGCCC CTCCGTCTTCCTGTTTCCCCCAAGCCCAAGGACACCCTGATGATCTCCCGGAC ACCCGAAGTCACCTGCGTCGTGGTGGATGTCAGCCAGGAAGATCCCGAGGTGC AGTTCAACTGGTACGTGGACGGAGTGGAGGTGCATAACGCCAAAACCAAGCCC AGGGAAGAGCAGTTCAACAGCACCTATCGGGTCGTGTCCGTGCTCACCGTCCTG CATCAGGATTGGCTCAACGGCAAGGAGTACAAGTGCAAGGTGTCCAACAAGGG CCTGCCCTCCTCCATCGAGAAGACCATCTCCAAGGCTAAGGGCCAACCTCGGGA GCCCCAAGTGTATACCCTCCCTCCCAGCCAGGAGGAGATGACCAAGAATCAAG TGAGCCTGACCTGCCTCGTGAAGGGATTTTACCCCTCCGACATCGCTGTGGAAT GGGAAAGCAATGGCCAACCTGAGAACAACTACAAGACCACACCCCCCGTGCTG GACTCCGATGGCTCCTTCTTCCTGTACAGCAGGCTGACCGTGGACAAATCCCGG TGGCAAGAGGGAAACGTGTTCAGCTGCTCCGTGATGCACGAGGCTCTCCACAA CCACTACACCCAGAAGAGCCTCTCCCTGAGCCTCGGCTAGTAA |

Figure 31 cont.

| Antibody | SEQ ID NO: | HC nucleic acid sequence |
|---|---|---|
| 19D9.2E5 | 727 | CAGATCCAGTTGGTACAGTCTGGACCTGAGCTGAAGAAGCCTGGAGAGACAGT CAAGATCTCCTGCAAGGCTTCTGGATATACCTTCACAACCTATGGAATGGGCTG GGTGAAACAGGCTCCAGGAAAGGGTTTGAAGTGGATGGGCTGGATAAACACCT ACTCTGGCGTGCCAACATATGCTGATGACTTCAAGGGACGGTTTGCCTTCTCTTT GGAAACCTCTACCAGCACTGCCTATTTGCAGATCAACAACCTCAAAAATGAGG ACATGGCTACATATTTCTGTGCAACCCCTTATGAATACGACGGGGCTTACTGGG GCCAAGGGACTCTGGTCACTGTCTCTGCAGCTAGCACCAAGGGCCCCAGCGTGT TTCCTCTCGCTCCCTGCAGCCGGAGCACATCCGAGAGCACCGCTGCTCTGGGCT GTCTCGTGAAGGACTACTTCCCTGAACCCGTCACCGTCAGCTGGAATAGCGGCG CCCTGACATCCGGCGTCCACACATTCCCCGCTGTCCTGCAGAGCAGCGGCCTGT ACAGCCTGAGCTCCGTGGTCACCGTGCCTAGCAGCAGCCTGGGAACAAAGACC TACACCTGCAACGTGGACCATAAGCCCTCCAACACCAAGGTGGACAAGCGGGT GGAATCCAAGTATGGACCCCCTGTCCTCCTTGCCCTGCTCCTGAATTTCTCGGA GGCCCCTCCGTCTTCCTGTTTCCCCCAAGCCCAAGGACACCCTGATGATCTCCC GGACACCCGAAGTCACCTGCGTCGTGGTGGATGTCAGCCAGGAAGATCCCGAG GTGCAGTTCAACTGGTACGTGGACGGAGTGGAGGTGCATAACGCCAAAACCAA GCCCAGGGAAGAGCAGTTCAACAGCACCTATCGGGTCGTGTCCGTGCTCACCGT CCTGCATCAGGATTGGCTCAACGGCAAGGAGTACAAGTGCAAGGTGTCCAACA AGGGCCTGCCCTCCTCCATCGAGAAGACCATCTCCAAGGCTAAGGGCCAACCTC GGGAGCCCCAAGTGTATACCCTCCCTCCCAGCCAGGAGGAGATGACCAAGAAT CAAGTGAGCCTGACCTGCCTCGTGAAGGGATTTTACCCTCCGACATCGCTGTG GAATGGGAAAGCAATGGCCAACCTGAGAACAACTACAAGACCACACCCCCGT GCTGGACTCCGATGGCTCCTTCTTCCTGTACAGCAGGCTGACCGTGGACAAATC CCGGTGGCAAGAGGGAAACGTGTTCAGCTGCTCCGTGATGCACGAGGCTCTCC ACAACCACTACACCCAGAAGAGCCTCTCCCTGAGCCTCGGCTAGTAA |
| 23B10.2B12 | 728 | CAGGTCCAGCTGCAGCAGTCTGGACCTGAACTGGTGAAGCCTGGGGATTCTGTG AAGATATCCTGCAAGGCTGCTGGCTACACCTTCAGTGACTATTATATAAACTGG GTGAAGCAGAGGCCTGGACAGGGACTTGAGTGGATTGGATGGATTTATCCTGT AAGCGTTAATACTAAGTACAATGAGAAGTTCAAGGGCAAGGCCACATTGACTG TAGACACATCCTCCAGCACAGCCTACATGCAGCTCAGCAGCCTGACCTCTGAGG ACTCTGGGGTCTATTTCTGTGCCTACCTTGATTATTGGGGCCAAGGGACTCTGGT CACTGTCTCTGCAGCTAGCACCAAGGGCCCCAGCGTGTTTCCTCTCGCTCCCTGC AGCCGGAGCACATCCGAGAGCACCGCTGCTCTGGGCTGTCTCGTGAAGGACTA CTTCCCTGAACCCGTCACCGTCAGCTGGAATAGCGGCGCCCTGACATCCGGCGT CCACACATTCCCCGCTGTCCTGCAGAGCAGCGGCCTGTACAGCCTGAGCTCCGT GGTCACCGTGCCTAGCAGCAGCCTGGGAACAAAGACCTACACCTGCAACGTGG ACCATAAGCCCTCCAACACCAAGGTGGACAAGCGGGTGGAATCCAAGTATGGA CCCCCTGTCCTCCTTGCCCTGCTCCTGAATTTCTCGGAGGCCCCTCCGTCTTCC TGTTTCCCCCAAGCCCAAGGACACCCTGATGATCTCCCGGACACCCGAAGTCA CCTGCGTCGTGGTGGATGTCAGCCAGGAAGATCCCGAGGTGCAGTTCAACTGGT ACGTGGACGGAGTGGAGGTGCATAACGCCAAAACCAAGCCCAGGGAAGAGCA GTTCAACAGCACCTATCGGGTCGTGTCCGTGCTCACCGTCCTGCATCAGGATTG GCTCAACGGCAAGGAGTACAAGTGCAAGGTGTCCAACAAGGGCCTGCCCTCCT CCATCGAGAAGACCATCTCCAAGGCTAAGGGCCAACCTCGGGAGCCCCAAGTG TATACCCTCCCTCCCAGCCAGGAGGAGATGACCAAGAATCAAGTGAGCCTGAC CTGCCTCGTGAAGGGATTTTACCCTCCGACATCGCTGTGGAATGGGAAAGCAA TGGCCAACCTGAGAACAACTACAAGACCACACCCCCGTGCTGGACTCCGATG GCTCCTTCTTCCTGTACAGCAGGCTGACCGTGGACAAATCCCGGTGGCAAGAGG GAAACGTGTTCAGCTGCTCCGTGATGCACGAGGCTCTCCACAACCACTACACCC AGAAGAGCCTCTCCCTGAGCCTCGGCTAGTAA |

Figure 31 cont.

| Antibody | SEQ ID NO: | HC nucleic acid sequence |
|---|---|---|
| 24D12.2H9 | 729 | CAGGTGCAGCTGAAGCAGTCAGGACCTGGCCTAGTGCAGCCCTCACAGAGCCTGT CCATCACCTGCACAGTCTCTGGTTTCTCATTAACTAGCTATGGTGTACACTGGGTT CGCCAGGCTCCAGGAAAGGGTCTGGAATGGCTGGGAGTGATATGGAGTGGTGGA AGCACAGACTATAATGCTGCTTTCATGTCCAGACTGAGCATCAGCAAGGACAACT CCAAGAGCCAAGTTTTCTTTAAAATGAACAGTCTGCAAGCTGATGACACTGCCAT ATACTACTGTGCCAAAAGCCCTGATGGTTACGACGTCGCCTGGTTTGGTTACTGGG GCCAAGGGACTCTGGTCACTGTCTCTGCAGCTAGCACCAAGGGCCCCAGCGTGTT TCCTCTCGCTCCCTGCAGCCGGAGCACATCCGAGAGCACCGCTGCTCTGGGCTGTC TCGTGAAGGACTACTTCCCTGAACCCGTCACCGTCAGCTGGAATAGCGGCGCCCT GACATCCGGCGTCCACACATTCCCCGCTGTCCTGCAGAGCAGCGGCCTGTACAGC CTGAGCTCCGTGGTCACCGTGCCTAGCAGCAGCCTGGGAACAAAGACCTACACCT GCAACGTGGACCATAAGCCCTCCAACACCAAGGTGGACAAGCGGGTGGAATCCA AGTATGGACCCCCTGTCCTCCTTGCCCTGCTCCTGAATTTCTCGGAGGCCCCTCC GTCTTCCTGTTTCCCCCAAGCCCAAGGACACCCTGATGATCTCCCGGACACCCGA AGTCACCTGCGTCGTGGTGGATGTCAGCCAGGAAGATCCCGAGGTGCAGTTCAAC TGGTACGTGGACGGAGTGGAGGTGCATAACGCCAAAACCAAGCCCAGGGAAGAG CAGTTCAACAGCACCTATCGGGTCGTGTCCGTGCTCACCGTCCTGCATCAGGATTG GCTCAACGGCAAGGAGTACAAGTGCAAGGTGTCCAACAAGGGCCTGCCCTCCTCC ATCGAGAAGACCATCTCCAAGGCTAAGGGCCAACCTCGGGAGCCCCAAGTGTATA CCCTCCCTCCCAGCCAGGAGGAGATGACCAAGAATCAAGTGAGCCTGACCTGCCT CGTGAAGGGATTTTACCCCTCCGACATCGCTGTGGAATGGGAAAGCAATGGCCAA CCTGAGAACAACTACAAGACCACACCCCCGTGCTGGACTCCGATGGCTCCTTCT TCCTGTACAGCAGGCTGACCGTGGACAAATCCCGGTGGCAAGAGGGAAACGTGTT CAGCTGCTCCGTGATGCACGAGGCTCTCCACAACCACTACACCCAGAAGAGCCTC TCCCTGAGCCTCGGCTAGTAA |
| F846C.1B2 | 730 | CAGATCCAGTTGGTGCAGTCTGGACCTGAGCTGAAGAAGCCTGGAGAGACAGTCA AGATCTCCTGCAAGGCTTCTGGGTATACCTTCACAAACTATGGAATGAATTGGGT GAAGCAGGCTCCAGGAAAGGGTTTAAAGTGGATGGGCTGGATAAACACCTACAC TGGAGAGCCATCATATGCTGATGACTTCAAGGGACGGTTTGCCTTCTCTTTGGAAA CCTCTGCCAGCACTGCCTATTTGCAGATCAACAACCTCAAAAATGAGGACATGGC TACATATTTCTGTGCAAGATGGGGGGGTTACGCTGGGGATTACTATGCTATGGAC TTCTGGGGTCAAGGAACCTCAGTCACCGTCTCCTCAGCTAGCACCAAGGGCCCCA GCGTGTTTCCTCTCGCTCCCTGCAGCCGGAGCACATCCGAGAGCACCGCTGCTCTG GGCTGTCTCGTGAAGGACTACTTCCCTGAACCCGTCACCGTCAGCTGGAATAGCG GCGCCCTGACATCCGGCGTCCACACATTCCCCGCTGTCCTGCAGAGCAGCGGCCT GTACAGCCTGAGCTCCGTGGTCACCGTGCCTAGCAGCAGCCTGGGAACAAAGACC TACACCTGCAACGTGGACCATAAGCCCTCCAACACCAAGGTGGACAAGCGGGTG GAATCCAAGTATGGACCCCCTGTCCTCCTTGCCCTGCTCCTGAATTTCTCGGAGG CCCCTCCGTCTTCCTGTTTCCCCCAAGCCCAAGGACACCCTGATGATCTCCCGGA CACCCGAAGTCACCTGCGTCGTGGTGGATGTCAGCCAGGAAGATCCCGAGGTGCA GTTCAACTGGTACGTGGACGGAGTGGAGGTGCATAACGCCAAAACCAAGCCCAG GGAAGAGCAGTTCAACAGCACCTATCGGGTCGTGTCCGTGCTCACCGTCCTGCAT CAGGATTGGCTCAACGGCAAGGAGTACAAGTGCAAGGTGTCCAACAAGGGCCTG CCCTCCTCCATCGAGAAGACCATCTCCAAGGCTAAGGGCCAACCTCGGGAGCCCC AAGTGTATACCCTCCCTCCCAGCCAGGAGGAGATGACCAAGAATCAAGTGAGCCT GACCTGCCTCGTGAAGGGATTTTACCCCTCCGACATCGCTGTGGAATGGGAAAGC AATGGCCAACCTGAGAACAACTACAAGACCACACCCCCGTGCTGGACTCCGATG GCTCCTTCTTCCTGTACAGCAGGCTGACCGTGGACAAATCCCGGTGGCAAGAGGG AAACGTGTTCAGCTGCTCCGTGATGCACGAGGCTCTCCACAACCACTACACCCAG AAGAGCCTCTCCCTGAGCCTCGGCTAGTAA |

Figure 31 cont.

| Antibody | SEQ ID NO: | HC nucleic acid sequence |
|---|---|---|
| F846C.1F5 | 731 | CAGATCCAGTTGGTGCAGTCTGGACCTGAGCTGAAGAAGCCTGGAGAGACAGTC AAGATCTCCTGCAAGGCTTCTGGGTATACCTTCACAAACTATGGAATGAACTGGG TGAAGCAGGCTCCAGGAAAGGGTTTAAAGTGGATGGGCTGGATAAACACCTACA CTGGAGAGCCATCATATGCTGATGACTTCAAGGGACGGTTTGCCTTCTCTTTGGA AACCTCTGCCAGCACTGCCTATTTGCAGATCAACAACCTCAAAAATGAGGACAT GGCTACATATTTCTGTGCAAGATGGGGGGGTTACGATGGGGATTACTATGCTATG GACTACTGGGGTCAAGGAACCTCAGTCACCGTCTCCTCAGCTAGCACCAAGGGC CCCAGCGTGTTTCCTCTCGCTCCCTGCAGCCGGAGCACATCCGAGAGCACCGCTG CTCTGGGCTGTCTCGTGAAGGACTACTTCCCTGAACCCGTCACCGTCAGCTGGAA TAGCGGCGCCCTGACATCCGGCGTCCACACATTCCCCGCTGTCCTGCAGAGCAGC GGCCTGTACAGCCTGAGCTCCGTGGTCACCGTGCCTAGCAGCAGCCTGGGAACA AAGACCTACACCTGCAACGTGGACCATAAGCCCTCCAACACCAAGGTGGACAAG CGGGTGGAATCCAAGTATGGACCCCCCTGTCCTCCTTGCCCTGCTCCTGAATTTC TCGGAGGCCCCTCCGTCTTCCTGTTTCCCCCCAAGCCCAAGGACACCCTGATGAT CTCCCGGACACCCGAAGTCACCTGCGTCGTGGTGGATGTCAGCCAGGAAGATCC CGAGGTGCAGTTCAACTGGTACGTGGACGGAGTGGAGGTGCATAACGCCAAAAC CAAGCCCAGGGAAGAGCAGTTCAACAGCACCTATCGGGTCGTGTCCGTGCTCAC CGTCCTGCATCAGGATTGGCTCAACGGCAAGGAGTACAAGTGCAAGGTGTCCAA CAAGGGCCTGCCCTCCTCATCGAGAAGACCATCTCCAAGGCTAAGGGCCAACC TCGGGAGCCCCAAGTGTATACCCTCCCTCCCAGCCAGGAGGAGATGACCAAGAA TCAAGTGAGCCTGACCTGCCTCGTGAAGGGATTTTACCCCTCCGACATCGCTGTG GAATGGGAAAGCAATGGCCAACCTGAGAACAACTACAAGACCACACCCCCCGT GCTGGACTCCGATGGCTCCTTCTTCCTGTACAGCAGGCTGACCGTGGACAAATCC CGGTGGCAAGAGGGAAACGTGTTCAGCTGCTCCGTGATGCACGAGGCTCTCCAC AACCACTACACCCAGAAGAGCCTCTCCCTGAGCCTCGGCTAGTAA |
| F846C.1H12 | 732 | CAGATCCAGTTGGTGCAGTCTGGACCTGAGCTGAAGAAGCCTGGAGAGACAGTC AAGATCTCCTGCAAGGCTTCTGGGTATACCTTCACAAACTTTGGAATGAACTGGG TGAAGCAGGCTCCAGGAAAGGGTTTAAAGTGGATGGGCTGGATAAACACCTACA CTGGAGAGCCATCATATGCTGATGACTTCAAGGGACGGTTTGCCTTCTCTTTGGA AACCTCTGCCAGCACTGCCTATTTGCAGATCAACAACCTCAAAAATGAGGACAT TGCTACATATTTCTGTGCAAGATGGGGGGGTTACGCTGGGGATTACTATGCTATG GACTACTGGGGTCAAGGAACCTCAGTCACCGTCTCCTCAGCTAGCACCAAGGGC CCCAGCGTGTTTCCTCTCGCTCCCTGCAGCCGGAGCACATCCGAGAGCACCGCTG CTCTGGGCTGTCTCGTGAAGGACTACTTCCCTGAACCCGTCACCGTCAGCTGGAA TAGCGGCGCCCTGACATCCGGCGTCCACACATTCCCCGCTGTCCTGCAGAGCAGC GGCCTGTACAGCCTGAGCTCCGTGGTCACCGTGCCTAGCAGCAGCCTGGGAACA AAGACCTACACCTGCAACGTGGACCATAAGCCCTCCAACACCAAGGTGGACAAG CGGGTGGAATCCAAGTATGGACCCCCCTGTCCTCCTTGCCCTGCTCCTGAATTTC TCGGAGGCCCCTCCGTCTTCCTGTTTCCCCCCAAGCCCAAGGACACCCTGATGAT CTCCCGGACACCCGAAGTCACCTGCGTCGTGGTGGATGTCAGCCAGGAAGATCC CGAGGTGCAGTTCAACTGGTACGTGGACGGAGTGGAGGTGCATAACGCCAAAAC CAAGCCCAGGGAAGAGCAGTTCAACAGCACCTATCGGGTCGTGTCCGTGCTCAC CGTCCTGCATCAGGATTGGCTCAACGGCAAGGAGTACAAGTGCAAGGTGTCCAA CAAGGGCCTGCCCTCCTCATCGAGAAGACCATCTCCAAGGCTAAGGGCCAACC TCGGGAGCCCCAAGTGTATACCCTCCCTCCCAGCCAGGAGGAGATGACCAAGAA TCAAGTGAGCCTGACCTGCCTCGTGAAGGGATTTTACCCCTCCGACATCGCTGTG GAATGGGAAAGCAATGGCCAACCTGAGAACAACTACAAGACCACACCCCCCGT GCTGGACTCCGATGGCTCCTTCTTCCTGTACAGCAGGCTGACCGTGGACAAATCC CGGTGGCAAGAGGGAAACGTGTTCAGCTGCTCCGTGATGCACGAGGCTCTCCAC AACCACTACACCCAGAAGAGCCTCTCCCTGAGCCTCGGCTAGTAA |

Figure 31 cont.

| Antibody | SEQ ID NO: | HC nucleic acid sequence |
|---|---|---|
| F846C.1H5 | 733 | GAGGTCCAGCTGTTGGAGTCTGGGGGAGGCTTAGTGAAGCCTGGAGGGTCCCTGAAACTCTCCTGTGCAGCCTCTGGATTCACTTTCAGCAGCTATGCCATGTCTTGGGTTCGCCAGACTCCAGAGAAGAGGCTGGAGTGGGTCGCATCCATTAGTAGTGGTGGTGACACCTACTATCCAGACAGTGTGAAGGGCCGATTCACCATCTCTAGAGATAATGCCAGGAACATCCTGTACCTGCAAATGAGCAGTCTGAGGTCTGAGGACACGGCCATGTATTACTGTGCAAGTTATGGTAACTCCCTCTTTGACTACTGGGGCCAAGGCACCACTCTCACAGTCTCCTCAGCTAGCACCAAGGGCCCCAGCGTGTTTCCTCTCGCTCCCTGCAGCCGGAGCACATCCGAGAGCACCGCTGCTCTGGGCTGTCTCGTGAAGGACTACTTCCCTGAACCCGTCACCGTCAGCTGGAATAGCGGCGCCCTGACATCCGGCGTCCACACATTCCCCGCTGTCCTGCAGAGCAGCGGCCTGTACAGCCTGAGCTCCGTGGTCACCGTGCCTAGCAGCAGCCTGGGAACAAAGACCTACACCTGCAACGTGGACCATAAGCCCTCCAACACCAAGGTGGACAAGCGGGTGGAATCCAAGTATGGACCCCCTGTCCTCCTTGCCCTGCTCCTGAATTTCTCGGAGGCCCCTCCGTCTTCCTGTTTCCCCCCAAGCCCAAGGACACCCTGATGATCTCCCGGACACCCGAAGTCACCTGCGTCGTGGTGGATGTCAGCCAGGAAGATCCCGAGGTGCAGTTCAACTGGTACGTGGACGGAGTGGAGGTGCATAACGCCAAAACCAAGCCCAGGGAAGAGCAGTTCAACAGCACCTATCGGGTCGTGTCCGTGCTCACCGTCCTGCATCAGGATTGGCTCAACGGCAAGGAGTACAAGTGCAAGGTGTCCAACAAGGGCCTGCCCTCCTCCATCGAGAAGACCATCTCCAAGGCTAAGGGCCAACCTCGGGAGCCCCAAGTGTATACCCTCCCTCCCAGCCAGGAGGAGATGACCAAGAATCAAGTGAGCCTGACCTGCCTCGTGAAGGGATTTTACCCCTCCGACATCGCTGTGGAATGGGAAAGCAATGGCCAACCTGAGAACAACTACAAGACCACACCCCCCGTGCTGGACTCCGATGGCTCCTTCTTCCTGTACAGCAGGCTGACCGTGGACAAATCCCGGTGGCAAGAGGGAAACGTGTTCAGCTGCTCCGTGATGCACGAGGCTCTCCACAACCACTACACCCAGAAGAGCCTCTCCCTGAGCCTCGGCTAGTAA |
| F846C.2H3 | 734 | CAGATCCAGTTGGTGCAGTCTGGACCTGAGCTGAAGAAGCCTGGAGAGACAGTCAAGATCTCCTGCAAGGCTTCTGGGTATACCTTCACAAACTATGGAATGAACTGGGTGAAGCAGGCTCCAGGAAAGGGTTTAAAGTGGATGGGCTGGATAAACACCTACACTGGAGAGCCATCATATGCTGATGACTTCAAGGGACGGTTTGCCTTCTCTTTGGAAACCTCTGCCAGCACTGCCTATTTGCAGATCAACAACCTCAAAAATGAGGACATGGCTACATATTTCTGTGCAAGATGGGGGGGTTACGATGGGGATTACTATGCTATGGACTACTGGGGTCAAGGAACCTCAGTCACCGTCTCCTCAGCTAGCACCAAGGGCCCCAGCGTGTTTCCTCTCGCTCCCTGCAGCCGGAGCACATCCGAGAGCACCGCTGCTCTGGGCTGTCTCGTGAAGGACTACTTCCCTGAACCCGTCACCGTCAGCTGGAATAGCGGCGCCCTGACATCCGGCGTCCACACATTCCCCGCTGTCCTGCAGAGCAGCGGCCTGTACAGCCTGAGCTCCGTGGTCACCGTGCCTAGCAGCAGCCTGGGAACAAAGACCTACACCTGCAACGTGGACCATAAGCCCTCCAACACCAAGGTGGACAAGCGGGTGGAATCCAAGTATGGACCCCCTGTCCTCCTTGCCCTGCTCCTGAATTTCTCGGAGGCCCCTCCGTCTTCCTGTTTCCCCCCAAGCCCAAGGACACCCTGATGATCTCCCGGACACCCGAAGTCACCTGCGTCGTGGTGGATGTCAGCCAGGAAGATCCCGAGGTGCAGTTCAACTGGTACGTGGACGGAGTGGAGGTGCATAACGCCAAAACCAAGCCCAGGGAAGAGCAGTTCAACAGCACCTATCGGGTCGTGTCCGTGCTCACCGTCCTGCATCAGGATTGGCTCAACGGCAAGGAGTACAAGTGCAAGGTGTCCAACAAGGGCCTGCCCTCCTCCATCGAGAAGACCATCTCCAAGGCTAAGGGCCAACCTCGGGAGCCCCAAGTGTATACCCTCCCTCCCAGCCAGGAGGAGATGACCAAGAATCAAGTGAGCCTGACCTGCCTCGTGAAGGGATTTTACCCCTCCGACATCGCTGTGGAATGGGAAAGCAATGGCCAACCTGAGAACAACTACAAGACCACACCCCCCGTGCTGGACTCCGATGGCTCCTTCTTCCTGTACAGCAGGCTGACCGTGGACAAATCCCGGTGGCAAGAGGGAAACGTGTTCAGCTGCTCCGTGATGCACGAGGCTCTCCACAACCACTACACCCAGAAGAGCCTCTCCCTGAGCCTCGGCTAGTAA |

Figure 31 cont.

| Antibody | SEQ ID NO: | HC nucleic acid sequence |
|---|---|---|
| F846TC.14A2 | 735 | CAGATCCAGTTGGTGCAGTCTGGACCTGAGCTGAAGAAGCCTGGAGAGACAGT CAAGATCTCCTGCAAGGCTTCTGGGTATACCTTCACAAACTATGGAATGAACTG GGTGAAGCAGGCTCCAGGAAAGGGTTTAAAGTGGATGGGCTGGATAAACACCT ACACTGGAGAGCCAACATATGCTGGTGACCTCAAGGGACGGTTTGCCTTCTCTT TGGAAACCTCTGCCAGCACTGCCTATTTGCAGATCAACAACCTCAAAAATGAGG ACACGGCTACATATTTCTGTGTAAGATATACTATGGACTACTGGGGTCAAGGAA CCTCAGTCACCGTCTCCTCAGCTAGCACCAAGGGCCCCAGCGTGTTTCCTCTCG CTCCCTGCAGCCGGAGCACATCCGAGAGCACCGCTGCTCTGGGCTGTCTCGTGA AGGACTACTTCCCTGAACCCGTCACCGTCAGCTGGAATAGCGGCGCCCTGACAT CCGGCGTCCACACATTCCCCGCTGTCCTGCAGAGCAGCGGCCTGTACAGCCTGA GCTCCGTGGTCACCGTGCCTAGCAGCAGCCTGGAACAAAGACCTACACCTGC AACGTGGACCATAAGCCCTCCAACACCAAGGTGGACAAGCGGGTGGAATCCAA GTATGGACCCCCCTGTCCTCCTTGCCCCTGCTCCTGAATTTCTCGGAGGCCCCTCC GTCTTCCTGTTTCCCCCCAAGCCCAAGGACACCCTGATGATCTCCCGGACACCC GAAGTCACCTGCGTCGTGGTGGATGTCAGCCAGGAAGATCCCGAGGTGCAGTT CAACTGGTACGTGGACGGAGTGGAGGTGCATAACGCCAAAACCAAGCCCAGGG AAGAGCAGTTCAACAGCACCTATCGGGTCGTGTCCGTGCTCACCGTCCTGCATC AGGATTGGCTCAACGGCAAGGAGTACAAGTGCAAGGTGTCCAACAAGGGCCTG CCCTCCTCCATCGAGAAGACCATCTCCAAGGCTAAGGGCCAACCTCGGGAGCCC CAAGTGTATACCCTCCCTCCCAGCCAGGAGGAGATGACCAAGAATCAAGTGAG CCTGACCTGCCTCGTGAAGGGATTTTACCCCTCCGACATCGCTGTGGAATGGGA AAGCAATGGCCAACCTGAGAACAACTACAAGACCACACCCCCCGTGCTGGACT CCGATGGCTCCTTCTTCCTGTACAGCAGGCTGACCGTGGACAAATCCCGGTGGC AAGAGGGAAACGTGTTCAGCTGCTCCGTGATGCACGAGGCTCTCCACAACCACT ACACCCAGAAGAGCCTCTCCCTGAGCCTCGGCTAGTAA |
| F846TC.14E4 | 736 | CAGGTTACTCTGAAAGAGTCTGGCCCTGGGATATTGCAGCCCTCCCAGACCCTC AGTCTGACTTGTTCTTTCTCTGGGTTTTCACTGAGCACTTCTGGTATGGGTGTAG GCTGGATTCGTCAGCCTTCAGGGAAGGGTCTGGAGTGGCTGGCACACATTTGGT GGGATGATGATAAGTACTATAACACAGCCCTGAAGAGCGGGCTCACAATCTCC AAGGATGCCTCCAAAAACCAGGTCTTCCTCAAGATCGCCAGTATGGACACTGCA GATACTGCCACATACTACTGTGCTCGAAACCTCTATGATGGTTCCTACGGGTAC TATGCTATGGACTACTGGGGTCAAGGAACCTCAGTCACCGTCTCCTCAGCTAGC ACCAAGGGCCCCAGCGTGTTTCCTCTCGCTCCCTGCAGCCGGAGCACATCCGAG AGCACCGCTGCTCTGGGCTGTCTCGTGAAGGACTACTTCCCTGAACCCGTCACC GTCAGCTGGAATAGCGGCGCCCTGACATCCGGCGTCCACACATTCCCCGCTGTC CTGCAGAGCAGCGGCCTGTACAGCCTGAGCTCCGTGGTCACCGTGCCTAGCAGC AGCCTGGGAACAAAGACCTACACCTGCAACGTGGACCATAAGCCCTCCAACAC CAAGGTGGACAAGCGGGTGGAATCCAAGTATGGACCCCCCTGTCCTCCTTGCCC TGCTCCTGAATTTCTCGGAGGCCCCTCCGTCTTCCTGTTTCCCCCCAAGCCCAAG GACACCCTGATGATCTCCCGGACACCCGAAGTCACCTGCGTCGTGGTGGATGTC AGCCAGGAAGATCCCGAGGTGCAGTTCAACTGGTACGTGGACGGAGTGGAGGT GCATAACGCCAAAACCAAGCCCAGGGAAGAGCAGTTCAACAGCACCTATCGGG TCGTGTCCGTGCTCACCGTCCTGCATCAGGATTGGCTCAACGGCAAGGAGTACA AGTGCAAGGTGTCCAACAAGGGCCTGCCCTCCTCCATCGAGAAGACCATCTCCA AGGCTAAGGGCCAACCTCGGGAGCCCCAAGTGTATACCCTCCCTCCCAGCCAG GAGGAGATGACCAAGAATCAAGTGAGCCTGACCTGCCTCGTGAAGGGATTTTA CCCCTCCGACATCGCTGTGGAATGGGAAAGCAATGGCCAACCTGAGAACAACT ACAAGACCACACCCCCCGTGCTGGACTCCGATGGCTCCTTCTTCCTGTACAGCA GGCTGACCGTGGACAAATCCCGGTGGCAAGAGGGAAACGTGTTCAGCTGCTCC GTGATGCACGAGGCTCTCCACAACCACTACACCCAGAAGAGCCTCTCCCTGAGC CTCGGCTAGTAA |

Figure 31 cont.

| Antibody | SEQ ID NO: | HC nucleic acid sequence |
|---|---|---|
| F846TC.16B5 | 737 | CAGATCCAGTTGGTGCAGTCTGGACCTGAGCTGAAGAAGCCTGGAGAGACAGTC AAGATCTCCTGCAAGGCTTCTGGGTATACCTTCACAAACTATGGAATGAACTGGG TGAAGCAGGCTCCAGGAAAGGGTTTAAAGTGGATGGGCTGGATAAACACCTACA CTGGAGAGCCAGCATATGCTGATGACTTCAAGGGACGGTTTGCCTTCTCTTTGGA AACCTCTGCCAGCACTGCCTATTTGCAGATCAACAACCTCAAAAATGAGGACAT GGCTACATATTTCTGTGCAAGATGGGGGGGTTACGATGGGGATTACTATGCTATG GACTACTGGGGTCAAGGAACCTCAGTCACCGTCTCCTCAGCTAGCACCAAGGGC CCCAGCGTGTTTCCTCTCGCTCCCTGCAGCCGGAGCACATCCGAGAGCACCGCTG CTCTGGGCTGTCTCGTGAAGGACTACTTCCCTGAACCCGTCACCGTCAGCTGGAA TAGCGGCGCCCTGACATCCGGCGTCCACACATTCCCCGCTGTCCTGCAGAGCAGC GGCCTGTACAGCCTGAGCTCCGTGGTCACCGTGCCTAGCAGCAGCCTGGGAACA AAGACCTACACCTGCAACGTGGACCATAAGCCTCCAACACCAAGGTGGACAAG CGGGTGGAATCCAAGTATGGACCCCCCTGTCCTCCTTGCCCTGCTCCTGAATTTC TCGGAGGCCCCTCCGTCTTCCTGTTTCCCCCCAAGCCCAAGGACACCCTGATGAT CTCCCGGACACCCGAAGTCACCTGCGTCGTGGTGGATGTCAGCCAGGAAGATCC CGAGGTGCAGTTCAACTGGTACGTGGACGGAGTGGAGGTGCATAACGCCAAAAC CAAGCCCAGGGAAGAGCAGTTCAACAGCACCTATCGGGTCGTGTCCGTGCTCAC CGTCCTGCATCAGGATTGGCTCAACGGCAAGGAGTACAAGTGCAAGGTGTCCAA CAAGGGCCTGCCCTCCTCATCGAGAAGACCATCTCCAAGGCTAAGGGCCAACC TCGGGAGCCCCAAGTGTATACCCTCCCTCCCAGCCAGGAGGAGATGACCAAGAA TCAAGTGAGCCTGACCTGCCTCGTGAAGGGATTTTACCCCTCCGACATCGCTGTG GAATGGGAAAGCAATGGCCAACCTGAGAACAACTACAAGACCACACCCCCCGT GCTGGACTCCGATGGCTCCTTCTTCCTGTACAGCAGGCTGACCGTGGACAAATCC CGGTGGCAAGAGGGAAACGTGTTCAGCTGCTCCGTGATGCACGAGGCTCTCCAC AACCACTACACCCAGAAGAGCCTCTCCCTGAGCCTCGGCTAGTAA |
| F846TC.7F10 | 738 | GAAGTGCAGCTGGTGGAGTCTGGGGGAGACTTAGTGAAGCCTGGAGGGTCCCTG AAACTCTCCTGTGCAGCCTCTGGATTCACTTTCAGTAACTATGGCTTGTCTTGGAT TCGCCAGACTCCAGACAAGAGGCTGGAGTGGGTCGCAACCATTAGTAGTGGTGG TAGTTACACCTACTATCCTGACAGTGTGAAGGGGCGATTCACCATCTCCAGAGAC AGTGCCAAGAACACCCTGTACCTGCAAATGAGCAGTCTGAAGTCTGAGGACACA GCCATGTATTACTGTGCAAGACATGCGCATTACTACGGTGTTAGCCCGTACTACT TTGACTACTGGGGCCAAGGCACCTGTCTCACAGTCTCCTCAGCTAGCACCAAGG GCCCCAGCGTGTTTCCTCTCGCTCCCTGCAGCCGGAGCACATCCGAGAGCACCGC TGCTCTGGGCTGTCTCGTGAAGGACTACTTCCCTGAACCCGTCACCGTCAGCTGG AATAGCGGCGCCCTGACATCCGGCGTCCACACATTCCCCGCTGTCCTGCAGAGC AGCGGCCTGTACAGCCTGAGCTCCGTGGTCACCGTGCCTAGCAGCAGCCTGGGA ACAAAGACCTACACCTGCAACGTGGACCATAAGCCTCCAACACCAAGGTGGAC AAGCGGGTGGAATCCAAGTATGGACCCCCCTGTCCTCCTTGCCCTGCTCCTGAAT TTCTCGGAGGCCCCTCCGTCTTCCTGTTTCCCCCCAAGCCCAAGGACACCCTGAT GATCTCCCGGACACCCGAAGTCACCTGCGTCGTGGTGGATGTCAGCCAGGAAGA TCCCGAGGTGCAGTTCAACTGGTACGTGGACGGAGTGGAGGTGCATAACGCCAA AACCAAGCCCAGGGAAGAGCAGTTCAACAGCACCTATCGGGTCGTGTCCGTGCT CACCGTCCTGCATCAGGATTGGCTCAACGGCAAGGAGTACAAGTGCAAGGTGTC CAACAAGGGCCTGCCCTCCTCATCGAGAAGACCATCTCCAAGGCTAAGGGCCA ACCTCGGGAGCCCCAAGTGTATACCCTCCCTCCCAGCCAGGAGGAGATGACCAA GAATCAAGTGAGCCTGACCTGCCTCGTGAAGGGATTTTACCCCTCCGACATCGCT GTGGAATGGGAAAGCAATGGCCAACCTGAGAACAACTACAAGACCACACCCCC CGTGCTGGACTCCGATGGCTCCTTCTTCCTGTACAGCAGGCTGACCGTGGACAAA TCCCGGTGGCAAGAGGGAAACGTGTTCAGCTGCTCCGTGATGCACGAGGCTCTC CACAACCACTACACCCAGAAGAGCCTCTCCCTGAGCCTCGGCTAGTAA |

Figure 31 cont.

| Antibody | SEQ ID NO: | HC nucleic acid sequence |
|---|---|---|
| F847C.10B9 | 739 | CAGATCCAGTTGGTGCAGTCTGGACCTGAGGTGAAGAAGCCTGGAGAGACAGT CAAGATCTCCTGCAAGGCTTCTGGGTATATCTTCACAAACTATGGAATGAACTG GGTGAAGCAGGCTCCAGGAAAGGGTTTAAAGTGGATGGGCTGGATAAACACCT ACACTGGAGAGCCAACATATACTGATGACTTCAAGGGACGGTTTGCCTTCTCTT TGGAAACCTCTGCCAGCACTGCCTATTTGCAGATCAACAACCTCAAAAATGAGG ACACGGCTACATATTTCTGTGCAAAGTTGGTAACTACGTGGGAGCTATGGACT ACTGGGGTCAAGGAACCTCAGTCACCGTCTCCTCAGCTAGCACCAAGGGCCCCA GCGTGTTCCTCTCGCTCCCTGCAGCCGGAGCACATCCGAGAGCACCGCTGCTC TGGGCTGTCTCGTGAAGGACTACTTCCCTGAACCCGTCACCGTCAGCTGGAATA GCGGCGCCCTGACATCCGGCGTCCACACATTCCCCGCTGTCCTGCAGAGCAGCG GCCTGTACAGCCTGAGCTCCGTGGTCACCGTGCCTAGCAGCAGCCTGGGAACAA AGACCTACACCTGCAACGTGGACCATAAGCCCTCCAACACCAAGGTGGACAAG CGGGTGGAATCCAAGTATGGACCCCCTGTCCTCCTTGCCCTGCTCCTGAATTTC TCGGAGGCCCCTCCGTCTTCCTGTTTCCCCCCAAGCCCAAGGACACCCTGATGA TCTCCCGGACACCCGAAGTCACCTGCGTCGTGGTGGATGTCAGCCAGGAAGATC CCGAGGTGCAGTTCAACTGGTACGTGGACGGAGTGGAGGTGCATAACGCCAAA ACCAAGCCCAGGGAAGAGCAGTTCAACAGCACCTATCGGGTCGTGTCCGTGCT CACCGTCCTGCATCAGGATTGGCTCAACGGCAAGGAGTACAAGTGCAAGGTGT CCAACAAGGGCCTGCCCTCCTCATCGAGAAGACCATCTCCAAGGCTAAGGGC CAACCTCGGGAGCCCCAAGTGTATACCCTCCCTCCCAGCCAGGAGGAGATGAC CAAGAATCAAGTGAGCCTGACCTGCCTCGTGAAGGGATTTTACCCCTCCGACAT CGCTGTGGAATGGGAAAGCAATGGCCAACCTGAGAACAACTACAAGACCACAC CCCCCGTGCTGGACTCCGATGGCTCCTTCTTCCTGTACAGCAGGCTGACCGTGG ACAAATCCCGGTGGCAAGAGGGAAACGTGTTCAGCTGCTCCGTGATGCACGAG GCTCTCCACAACCACTACACCCAGAAGAGCCTCTCCCTGAGCCTCGGCTAGTAA |
| F847C.11B1 | 740 | GAGGTCCAGCTTCAGCAGTCTGGACCTGAGCTGGTGAAACCTGGGGCCTCAGTG AAGATATCCTGCAAGGCTTCTGGAAACACATTCACTGACCACAACATGCACTGG GTGAAGCAGAGCCATGGAAAGAGCCTTGAGTGGATTGGATATATTTATCCTTAC AATGGTGGTACTGGCTACAACCAGAAGTTCAAGAGCAAGGCCACATTGACTGT AGACAATTCCTCCAGCACAGTCTACATGGAGCTCCGCAGCCTGACATCTGAGGA CTCTGCAGTCTATTACTGTGCAAGAGGGGAGTATGATTACCTGGCCTGGTTTGC TTACTGGGGCCAAGGGACTCTGGTCACTGTCTCTGCAGCTAGCACCAAGGGCCC CAGCGTGTTCCTCTCGCTCCCTGCAGCCGGAGCACATCCGAGAGCACCGCTGC TCTGGGCTGTCTCGTGAAGGACTACTTCCCTGAACCCGTCACCGTCAGCTGGAA TAGCGGCGCCCTGACATCCGGCGTCCACACATTCCCCGCTGTCCTGCAGAGCAG CGGCCTGTACAGCCTGAGCTCCGTGGTCACCGTGCCTAGCAGCAGCCTGGGAAC AAAGACCTACACCTGCAACGTGGACCATAAGCCCTCCAACACCAAGGTGGACA AGCGGGTGGAATCCAAGTATGGACCCCCTGTCCTCCTTGCCCTGCTCCTGAAT TTCTCGGAGGCCCCTCCGTCTTCCTGTTTCCCCCCAAGCCCAAGGACACCCTGAT GATCTCCCGGACACCCGAAGTCACCTGCGTCGTGGTGGATGTCAGCCAGGAAG ATCCCGAGGTGCAGTTCAACTGGTACGTGGACGGAGTGGAGGTGCATAACGCC AAAACCAAGCCCAGGGAAGAGCAGTTCAACAGCACCTATCGGGTCGTGTCCGT GCTCACCGTCCTGCATCAGGATTGGCTCAACGGCAAGGAGTACAAGTGCAAGG TGTCCAACAAGGGCCTGCCCTCCTCCATCGAGAAGACCATCTCCAAGGCTAAGG GCCAACCTCGGGAGCCCCAAGTGTATACCCTCCCTCCCAGCCAGGAGGAGATG ACCAAGAATCAAGTGAGCCTGACCTGCCTCGTGAAGGGATTTTACCCCTCCGAC ATCGCTGTGGAATGGGAAAGCAATGGCCAACCTGAGAACAACTACAAGACCAC ACCCCCGTGCTGGACTCCGATGGCTCCTTCTTCCTGTACAGCAGGCTGACCGT GGACAAATCCCGGTGGCAAGAGGGAAACGTGTTCAGCTGCTCCGTGATGCACG AGGCTCTCCACAACCACTACACCCAGAAGAGCCTCTCCCTGAGCCTCGGCTAGT AA |

Figure 31 cont.

| Antibody | SEQ ID NO: | HC nucleic acid sequence |
|---|---|---|
| F847C.12F12 | 741 | CAGATCCAGTTGGTGCAGTCTGGACCTGAGCTGAAGAAGCCTGGAGAGACAGT CAAGATCTCCTGCAAGGCTTCTGGGTATACCTTCACAAACTATGGAATGAACTG GGTGAAGCAGGCTCCAGGAAAGGGTTTAAAGTGGATGGGCTGGATAAACACCT ACACTGGAGAGCCAACATATGTTGATGACTTCAAGGGACGGTTTGCCTTCTCTT TGGAAACCTCTGCCAGCACTGCCTATTTGCGGATCAACAACCTCAAAAATGAGG ACACGGCTACATATTTCTGTGCAAAGTTTGGTAACTACGTGGGAGCTATGGACT ACTGGGGTCAAGGAACCTCAGTCACCGTCTCCTCAGCTAGCACCAAGGGCCCCA GCGTGTTTCCTCTCGCTCCCTGCAGCCGGAGCACATCCGAGAGCACCGCTGCTC TGGGCTGTCTCGTGAAGGACTACTTCCCTGAACCCGTCACCGTCAGCTGGAATA GCGGCGCCCTGACATCCGGCGTCCACACATTCCCCGCTGTCCTGCAGAGCAGCG GCCTGTACAGCCTGAGCTCCGTGGTCACCGTGCCTAGCAGCAGCCTGGGAACAA AGACCTACACCTGCAACGTGGACCATAAGCCCTCCAACACCAAGGTGGACAAG CGGGTGGAATCCAAGTATGGACCCCCCTGTCCTCCTTGCCCTGCTCCTGAATTTC TCGGAGGCCCCTCCGTCTTCCTGTTTCCCCCAAGCCCAAGGACACCCTGATGA TCTCCCGGACACCCGAAGTCACCTGCGTCGTGGTGGATGTCAGCCAGGAAGATC CCGAGGTGCAGTTCAACTGGTACGTGGACGGAGTGGAGGTGCATAACGCCAAA ACCAAGCCCAGGGAAGAGCAGTTCAACAGCACCTATCGGGTCGTGTCCGTGCT CACCGTCCTGCATCAGGATTGGCTCAACGGCAAGGAGTACAAGTGCAAGGTGT CCAACAAGGGCCTGCCCTCCTCCATCGAGAAGACCATCTCCAAGGCTAAGGGC CAACCTCGGGAGCCCCAAGTGTATACCCTCCCTCCCAGCCAGGAGGAGATGAC CAAGAATCAAGTGAGCCTGACCTGCCTCGTGAAGGGATTTTACCCCTCCGACAT CGCTGTGGAATGGGAAAGCAATGGCCAACCTGAGAACAACTACAAGACCACAC CCCCCGTGCTGGACTCCGATGGCTCCTTCTTCCTGTACAGCAGGCTGACCGTGG ACAAATCCCGGTGGCAAGAGGGAAACGTGTTCAGCTGCTCCGTGATGCACGAG GCTCTCCACAACCACTACACCCAGAAGAGCCTCTCCCTGAGCCTCGGCTAGTAA |
| F847C.26F5 | 742 | CAGATCCAGTTGGTGCAGTCTGGACCTGAGGTGAAGAAGCCTGGAGAGACAGT CAAGATCTCCTGCAAGGCTTCTGGGTATATCTTCACAAACTATGGAATGAACTG GGTGAAGCAGGCTCCAGGAAAGGGTTTAAAGTGGATGGGCTGGATAAACACCT ACACTGGAGAGCCAACATATACTGATGACTTCAAGGGACGGTTTGCCTTCTCTT TGGAAACCTCTGCCAGCACTGCCTATTTGCAGATCAACAACCTCAAAAATGAGG ACACGGCTACATATTTCTGTGCAAAGTTTGGTAACTACGTGGGAGCTATGGACT ACTGGGGTCAAGGAACCTCAGTCACCGTCTCCTCAGCTAGCACCAAGGGCCCCA GCGTGTTTCCTCTCGCTCCCTGCAGCCGGAGCACATCCGAGAGCACCGCTGCTC TGGGCTGTCTCGTGAAGGACTACTTCCCTGAACCCGTCACCGTCAGCTGGAATA GCGGCGCCCTGACATCCGGCGTCCACACATTCCCCGCTGTCCTGCAGAGCAGCG GCCTGTACAGCCTGAGCTCCGTGGTCACCGTGCCTAGCAGCAGCCTGGGAACAA AGACCTACACCTGCAACGTGGACCATAAGCCCTCCAACACCAAGGTGGACAAG CGGGTGGAATCCAAGTATGGACCCCCCTGTCCTCCTTGCCCTGCTCCTGAATTTC TCGGAGGCCCCTCCGTCTTCCTGTTTCCCCCAAGCCCAAGGACACCCTGATGA TCTCCCGGACACCCGAAGTCACCTGCGTCGTGGTGGATGTCAGCCAGGAAGATC CCGAGGTGCAGTTCAACTGGTACGTGGACGGAGTGGAGGTGCATAACGCCAAA ACCAAGCCCAGGGAAGAGCAGTTCAACAGCACCTATCGGGTCGTGTCCGTGCT CACCGTCCTGCATCAGGATTGGCTCAACGGCAAGGAGTACAAGTGCAAGGTGT CCAACAAGGGCCTGCCCTCCTCCATCGAGAAGACCATCTCCAAGGCTAAGGGC CAACCTCGGGAGCCCCAAGTGTATACCCTCCCTCCCAGCCAGGAGGAGATGAC CAAGAATCAAGTGAGCCTGACCTGCCTCGTGAAGGGATTTTACCCCTCCGACAT CGCTGTGGAATGGGAAAGCAATGGCCAACCTGAGAACAACTACAAGACCACAC CCCCCGTGCTGGACTCCGATGGCTCCTTCTTCCTGTACAGCAGGCTGACCGTGG ACAAATCCCGGTGGCAAGAGGGAAACGTGTTCAGCTGCTCCGTGATGCACGAG GCTCTCCACAACCACTACACCCAGAAGAGCCTCTCCCTGAGCCTCGGCTAGTAA |

Figure 31 cont.

| Antibody | SEQ ID NO: | HC nucleic acid sequence |
|---|---|---|
| F847C.4B10 | 743 | GAGGTGCAGCTTGTTGAGACTGGGGGAGGCTTAGTGAAGCCTGGAGGGTCCCT GAAACTCTCCTGTGCAGCCTCTGGATTCACTTTCAGTAGCTATGCCATGTCTTGG GTTCGCCAGACTCCAGAGAAGAGGCTGGAGTGGGTCGCATCCATTAGTAGTGG TGGTAGCACCTACTATCCAGACAGTGTGAAGGGCCGATTCACCATCTCCAGAGA TAATGCCAGGAACATCCTGTACCTGCAAATGAGCAGTCTGAGGTCTGAGGACA CGGCCATGTATTACTGTACAAGGTTTACTACGGTAGTAGAGATGGACTACTGGG GTCAAGGAACCTCAGTCACCGTCTCCTCAGCTAGCACCAAGGGCCCCAGCGTGT TTCCTCTCGCTCCCTGCAGCCGGAGCACATCCGAGAGCACCGCTGCTCTGGGCT GTCTCGTGAAGGACTACTTCCCTGAACCCGTCACCGTCAGCTGGAATAGCGGCG CCCTGACATCCGGCGTCCACACATTCCCCGCTGTCCTGCAGAGCAGCGGCCTGT ACAGCCTGAGCTCCGTGGTCACCGTGCCTAGCAGCAGCCTGGGAACAAAGACC TACACCTGCAACGTGGACCATAAGCCCTCCAACACCAAGGTGGACAAGCGGGT GGAATCCAAGTATGGACCCCCTGTCCTCCTTGCCCTGCTCCTGAATTTCTCGGA GGCCCCTCCGTCTTCCTGTTTCCCCCAAGCCCAAGGACACCCTGATGATCTCCC GGACACCCGAAGTCACCTGCGTCGTGGTGGATGTCAGCCAGGAAGATCCCGAG GTGCAGTTCAACTGGTACGTGGACGGAGTGGAGGTGCATAACGCCAAAACCAA GCCCAGGGAAGAGCAGTTCAACAGCACCTATCGGGTCGTGTCCGTGCTCACCGT CCTGCATCAGGATTGGCTCAACGGCAAGGAGTACAAGTGCAAGGTGTCCAACA AGGGCCTGCCCTCCTCCATCGAGAAGACCATCTCCAAGGCTAAGGGCCAACCTC GGGAGCCCCAAGTGTATACCCTCCCTCCCAGCCAGGAGGAGATGACCAAGAAT CAAGTGAGCCTGACCTGCCTCGTGAAGGGATTTTACCCTCCGACATCGCTGTG GAATGGGAAAGCAATGGCCAACCTGAGAACAACTACAAGACCACACCCCCCGT GCTGGACTCCGATGGCTCCTTCTTCCTGTACAGCAGGCTGACCGTGGACAAATC CCGGTGGCAAGAGGGAAACGTGTTCAGCTGCTCCGTGATGCACGAGGCTCTCC ACAACCACTACACCCAGAAGAGCCTCTCCCTGAGCCTCGGCTAGTAA |
| F849C.8D10 | 744 | CAGGTCCAACTGCAGCAGACTGGTGCTGAGCTTGTGAAGCCTGGGGCCTCAGTG AAGCTGTCCTGCAAGGCTTCTGGCTATACTTTCACCAGCTACTGGATAAACTGG GTGAAGCAGAGGCCTGGACAAGGCCTTGAGTGGATTGGAAACATTTATCCTGG TAGTAGTAGTATTTACTACAGTGAGAAGTTCAAGAGTAAGGCCACACTGACTGT AGACACATCCTCCAGCACAGCCTACATGCAGCTCAGCAGCCTGACATCTGACGA CTCTGCGGTCTATTATTGTGCAAGATGGGGCTACTGGGGCCAAGGCACCACTCT CACAGTCTCCTCAGCTAGCACCAAGGGCCCCAGCGTGTTTCCTCTCGCTCCCTG CAGCCGGAGCACATCCGAGAGCACCGCTGCTCTGGGCTGTCTCGTGAAGGACT ACTTCCCTGAACCCGTCACCGTCAGCTGGAATAGCGGCGCCCTGACATCCGGCG TCCACACATTCCCCGCTGTCCTGCAGAGCAGCGGCCTGTACAGCCTGAGCTCCG TGGTCACCGTGCCTAGCAGCAGCCTGGGAACAAAGACCTACACCTGCAACGTG GACCATAAGCCCTCCAACACCAAGGTGGACAAGCGGGTGGAATCCAAGTATGG ACCCCCTGTCCTCCTTGCCCTGCTCCTGAATTTCTCGGAGGCCCCTCCGTCTTC CTGTTTCCCCCAAGCCCAAGGACACCCTGATGATCTCCCGGACACCCGAAGTC ACCTGCGTCGTGGTGGATGTCAGCCAGGAAGATCCCGAGGTGCAGTTCAACTG GTACGTGGACGGAGTGGAGGTGCATAACGCCAAAACCAAGCCCAGGGAAGAG CAGTTCAACAGCACCTATCGGGTCGTGTCCGTGCTCACCGTCCTGCATCAGGAT TGGCTCAACGGCAAGGAGTACAAGTGCAAGGTGTCCAACAAGGGCCTGCCCTC CTCCATCGAGAAGACCATCTCCAAGGCTAAGGGCCAACCTCGGGAGCCCCAAG TGTATACCCTCCCTCCCAGCCAGGAGGAGATGACCAAGAATCAAGTGAGCCTG ACCTGCCTCGTGAAGGGATTTTACCCTCCGACATCGCTGTGGAATGGGAAAGC AATGGCCAACCTGAGAACAACTACAAGACCACACCCCCGTGCTGGACTCCGA TGGCTCCTTCTTCCTGTACAGCAGGCTGACCGTGGACAAATCCCGGTGGCAAGA GGGAAACGTGTTCAGCTGCTCCGTGATGCACGAGGCTCTCCACAACCACTACAC CCAGAAGAGCCTCTCCCTGAGCCTCGGCTAGTAA |

Figure 31 cont.

| Antibody | SEQ ID NO: | HC nucleic acid sequence |
|---|---|---|
| F849C.8H3 | 745 | CAGGTTACTCTGAAAGAGTCTGGCCCTGGGATATTGCAGCCCTCCCAGACCCTC AGTCTGACTTGTTCTTTCTCTGGGTTTTCACTGAGCACTTTTGGTATGGGTGTAG GCTGGATTCGTCAGCCTTCAGGGAAGGGTCTGGAGTGGCTGGCACACATTTGGT GGGATGATGATAAACACTATAACCCAGCCCTGAAGAGCCGGCTCACAATCTCC AAGGATACCTCCAAAAACCAGGTCTTCCTCAGGATCGCCAATGTGGACACTGCA GATAATGCCACATATTACTGTGCTCGAATCGACTATGGTGACTACGTCGGGTTT GCTTATTGGGGCCAAGGGACTCTGGTCACTGTCTCTGCAGCTAGCACCAAGGGC CCCAGCGTGTTTCCTCTCGCTCCCTGCAGCCGGAGCACATCCGAGAGCACCGCT GCTCTGGGCTGTCTCGTGAAGGACTACTTCCCTGAACCCGTCACCGTCAGCTGG AATAGCGGCGCCCTGACATCCGGCGTCCACACATTCCCCGCTGTCCTGCAGAGC AGCGGCCTGTACAGCCTGAGCTCCGTGGTCACCGTGCCTAGCAGCAGCCTGGGA ACAAAGACCTACACCTGCAACGTGGACCATAAGCCCTCCAACACCAAGGTGGA CAAGCGGGTGGAATCCAAGTATGGACCCCCCTGTCCTCCTTGCCCTGCTCCTGA ATTTCTCGGAGGCCCCTCCGTCTTCCTGTTTCCCCCCAAGCCCAAGGACACCCTG ATGATCTCCCGGACACCCGAAGTCACCTGCGTCGTGGTGGATGTCAGCCAGGA GATCCCGAGGTGCAGTTCAACTGGTACGTGGACGGAGTGGAGGTGCATAACGC CAAAACCAAGCCCAGGGAAGAGCAGTTCAACAGCACCTATCGGGTCGTGTCCG TGCTCACCGTCCTGCATCAGGATTGGCTCAACGGCAAGGAGTACAAGTGCAAG GTGTCCAACAAGGGCCTGCCCTCCTCCATCGAGAAGACCATCTCCAAGGCTAAG GGCCAACCTCGGGAGCCCCAAGTGTATACCCTCCCTCCCAGCCAGGAGGAGAT GACCAAGAATCAAGTGAGCCTGACCTGCCTCGTGAAGGGATTTTACCCCTCCGA CATCGCTGTGGAATGGGAAAGCAATGGCCAACCTGAGAACAACTACAAGACCA CACCCCCGTGCTGGACTCCGATGGCTCCTTCTTCCTGTACAGCAGGCTGACCG TGGACAAATCCCGGTGGCAAGAGGGAAACGTGTTCAGCTGCTCCGTGATGCAC GAGGCTCTCCACAACCACTACACCCAGAAGAGCCTCTCCCTGAGCCTCGGCTAG TAA |
| 846.2B11 | 746 | CAGGTCCAGCTACAGCAGTCTGGACCTGAGCTGGTGAGGCCTGGGGCTTTAGTG AAGATTTCCTGCAAGGCTTCTGGTTACACCTTCACAAGCTACGATATAAACTGG GTGAAGCAGAGGCCTGGACAGGGACTTGAGTGGATTGGATGGATTTATCCTGG AGATGGTAGTACTAAATATAATGAGAAATTCAAGGGCAAGGCCACACTGACTG CAGACAAATCCTCCAGCACAGCCTACATGCAGCTCAGCAGCCTGACTTCTGAGA ACTCTGCAGTCTATTTCTGTGCAAGAGAGGCGGCTTCTAATGCTATGGACTACT GGGGTCAAGGAACCTCAGTCACCGTCTCCTCAGCTAGCACCAAGGGCCCCAGC GTGTTTCCTCTCGCTCCCTGCAGCCGGAGCACATCCGAGAGCACCGCTGCTCTG GGCTGTCTCGTGAAGGACTACTTCCCTGAACCCGTCACCGTCAGCTGGAATAGC GGCGCCCTGACATCCGGCGTCCACACATTCCCCGCTGTCCTGCAGAGCAGCGGC CTGTACAGCCTGAGCTCCGTGGTCACCGTGCCTAGCAGCAGCCTGGGAACAAA GACCTACACCTGCAACGTGGACCATAAGCCCTCCAACACCAAGGTGGACAAGC GGGTGGAATCCAAGTATGGACCCCCCTGTCCTCCTTGCCCTGCTCCTGAATTTCT CGGAGGCCCCTCCGTCTTCCTGTTTCCCCCCAAGCCCAAGGACACCCTGATGAT CTCCCGGACACCCGAAGTCACCTGCGTCGTGGTGGATGTCAGCCAGGAAGATCC CGAGGTGCAGTTCAACTGGTACGTGGACGGAGTGGAGGTGCATAACGCCAAAA CCAAGCCCAGGGAAGAGCAGTTCAACAGCACCTATCGGGTCGTGTCCGTGCTC ACCGTCCTGCATCAGGATTGGCTCAACGGCAAGGAGTACAAGTGCAAGGTGTC CAACAAGGGCCTGCCCTCCTCCATCGAGAAGACCATCTCCAAGGCTAAGGGCC AACCTCGGGAGCCCCAAGTGTATACCCTCCCTCCCAGCCAGGAGGAGATGACC AAGAATCAAGTGAGCCTGACCTGCCTCGTGAAGGGATTTTACCCCTCCGACATC GCTGTGGAATGGGAAAGCAATGGCCAACCTGAGAACAACTACAAGACCACACC CCCCGTGCTGGACTCCGATGGCTCCTTCTTCCTGTACAGCAGGCTGACCGTGGA CAAATCCCGGTGGCAAGAGGGAAACGTGTTCAGCTGCTCCGTGATGCACGAGG CTCTCCACAACCACTACACCCAGAAGAGCCTCTCCCTGAGCCTCGGCTAGTAA |

Figure 31 cont.

| Antibody | SEQ ID NO: | HC nucleic acid sequence |
|---|---|---|
| 846.4D5 | 747 | GAAGTGAAGCTTGAGGAGTCTGGAGGAGGCTTGGTGCAACCTGGAGGATCCAT GAAACTCTCCTGTGTTGCCTCTGGATTCACTTTCAGTAACTACTGGATGAACTGG GTCCGCCAGTCTCCAGAGAAGGGGCTTGAGTGGGTTGCTGAAATTAGATTGAA ATCTAATAATTATGCAACACATTATGCGGAGTCTGTGAAAGGGAGGTTCACCAT CTCAAGAGATGATTCCAAAAGTAGTGTCTACCTGCAAATGAACAACTTAAGAG CTGAAGACACTGGCATTTATTACTGTACCAGGCACTACGGCTTTCCCTACTGGT ACTTCGATGTCTGGGGCGCAGGGACCACGGTCACCGTCTCCTCAGCTAGCACCA AGGGCCCCAGCGTGTTTCCTCTCGCTCCCTGCAGCCGGAGCACATCCGAGAGCA CCGCTGCTCTGGGCTGTCTCGTGAAGGACTACTTCCCTGAACCCGTCACCGTCA GCTGGAATAGCGGCGCCCTGACATCCGGCGTCCACACATTCCCCGCTGTCCTGC AGAGCAGCGGCCTGTACAGCCTGAGCTCCGTGGTCACCGTGCCTAGCAGCAGC CTGGGAACAAAGACCTACACCTGCAACGTGGACCATAAGCCCTCCAACACCAA GGTGGACAAGCGGGTGGAATCCAAGTATGGACCCCCCTGTCCTCCTTGCCCTGC TCCTGAATTTCTCGGAGGCCCCTCCGTCTTCCTGTTTCCCCCCAAGCCCAAGGAC ACCCTGATGATCTCCCGGACACCCGAAGTCACCTGCGTCGTGGTGGATGTCAGC CAGGAAGATCCCGAGGTGCAGTTCAACTGGTACGTGGACGGAGTGGAGGTGCA TAACGCCAAAACCAAGCCCAGGGAAGAGCAGTTCAACAGCACCTATCGGGTCG TGTCCGTGCTCACCGTCCTGCATCAGGATTGGCTCAACGGCAAGGAGTACAAGT GCAAGGTGTCCAACAAGGGCCTGCCCTCCTCCATCGAGAAGACCATCTCCAAG GCTAAGGGCCAACCTCGGGAGCCCCAAGTGTATACCCTCCCTCCCAGCCAGGA GGAGATGACCAAGAATCAAGTGAGCCTGACCTGCCTCGTGAAGGGATTTTACC CCTCCGACATCGCTGTGGAATGGGAAAGCAATGGCCAACCTGAGAACAACTAC AAGACCACACCCCCGTGCTGGACTCCGATGGCTCCTTCTTCCTGTACAGCAGG CTGACCGTGGACAAATCCCGGTGGCAAGAGGGAAACGTGTTCAGCTGCTCCGT GATGCACGAGGCTCTCCACAACCACTACACCCAGAAGAGCCTCTCCCTGAGCCT CGGCTAGTAA |
| 846T.1H2 | 748 | CAGATCCAGTTGGTGCAGTCTGGACCTGAGCTGAAGAAGCCTGGAGAGACAGT CAAGATCTCCTGCAAGGCTTCTGGGTATACCTTCACAAACTATGGAATGAACTG GGTGAAGCAGGCTCCAGGAAAGGGTTTAAAGTGGATGGGCTGGATAAACACCA ACACTGGAGAGCCAACATATGCTGAAGAGTTCAAGGGACGGTTTGCCTTCTCTT TGGAAACCTCTGCCAGCACTGCCTATTTGCAGATCAACAACCTCAAAAATGAGG ACACGGCTACATATTTCTGTGCAACCGGGGGGGGTAACTGGGACTTTGACTACT GGGGCCAAGGCACCACTCTCACAGTCTCCTCAGCTAGCACCAAGGGCCCCAGC GTGTTTCCTCTCGCTCCCTGCAGCCGGAGCACATCCGAGAGCACCGCTGCTCTG GGCTGTCTCGTGAAGGACTACTTCCCTGAACCCGTCACCGTCAGCTGGAATAGC GGCGCCCTGACATCCGGCGTCCACACATTCCCCGCTGTCCTGCAGAGCAGCGGC CTGTACAGCCTGAGCTCCGTGGTCACCGTGCCTAGCAGCAGCCTGGGAACAAA GACCTACACCTGCAACGTGGACCATAAGCCCTCCAACACCAAGGTGGACAAGC GGGTGGAATCCAAGTATGGACCCCCCTGTCCTCCTTGCCCTGCTCCTGAATTTCT CGGAGGCCCCTCCGTCTTCCTGTTTCCCCCCAAGCCCAAGGACACCCTGATGAT CTCCCGGACACCCGAAGTCACCTGCGTCGTGGTGGATGTCAGCCAGGAAGATCC CGAGGTGCAGTTCAACTGGTACGTGGACGGAGTGGAGGTGCATAACGCCAAAA CCAAGCCCAGGGAAGAGCAGTTCAACAGCACCTATCGGGTCGTGTCCGTGCTC ACCGTCCTGCATCAGGATTGGCTCAACGGCAAGGAGTACAAGTGCAAGGTGTC CAACAAGGGCCTGCCCTCCTCCATCGAGAAGACCATCTCCAAGGCTAAGGGCC AACCTCGGGAGCCCCAAGTGTATACCCTCCCTCCCAGCCAGGAGGAGATGACC AAGAATCAAGTGAGCCTGACCTGCCTCGTGAAGGGATTTTACCCCTCCGACATC GCTGTGGAATGGGAAAGCAATGGCCAACCTGAGAACAACTACAAGACCACACC CCCGTGCTGGACTCCGATGGCTCCTTCTTCCTGTACAGCAGGCTGACCGTGGA CAAATCCCGGTGGCAAGAGGGAAACGTGTTCAGCTGCTCCGTGATGCACGAGG CTCTCCACAACCACTACACCCAGAAGAGCCTCTCCCTGAGCCTCGGCTAGTAA |

Figure 31 cont.

| Antibody | SEQ ID NO: | HC nucleic acid sequence |
|---|---|---|
| 847.14H4 | 749 | CAGATCCAGTTGGTGCAGTCTGGACCTGAACTGACGAAGCCTGGAGAGACAGT CAAGATCTCCTGTAAGGCTTCTGGCTATACCTTCACAGACTATGGAATGAACTG GGTGAGGCAGGCTCCAGGAGAGACTTTAAAGTGGATGGGCTGGATAAACACCT ACACTGGAGAGCCAACATATGCTGATGACTTCAAGGGGCGGTTTGCCTTCTCTT TGGAATCCTCTGCCAGCACTGCCTATTTGCAGATCAACAACCTCAAAAATGAGG ACGTGGCTACATATTTCTGTGCAAGATACCCTATGGACTACTGGGGTCAAGGAA CCTCAGTCACCGTCTCCTCAGCTAGCACCAAGGGCCCCAGCGTGTTTCCTCTCG CTCCCTGCAGCCGGAGCACATCCGAGAGCACCGCTGCTCTGGGCTGTCTCGTGA AGGACTACTTCCCTGAACCCGTCACCGTCAGCTGGAATAGCGGCGCCCTGACAT CCGGCGTCCACACATTCCCCGCTGTCCTGCAGAGCAGCGGCCTGTACAGCCTGA GCTCCGTGGTCACCGTGCCTAGCAGCAGCCTGGAACAAAGACCTACACCTGC AACGTGGACCATAAGCCCTCCAACACCAAGGTGGACAAGCGGGTGGAATCCAA GTATGGACCCCCCTGTCCTCCTTGCCCTGCTCCTGAATTTCTCGGAGGCCCCTCC GTCTTCCTGTTTCCCCCCAAGCCCAAGGACACCCTGATGATCTCCCGGACACCC GAAGTCACCTGCGTCGTGGTGGATGTCAGCCAGGAAGATCCCGAGGTGCAGTT CAACTGGTACGTGGACGGAGTGGAGGTGCATAACGCCAAAACCAAGCCCAGGG AAGAGCAGTTCAACAGCACCTATCGGGTCGTGTCCGTGCTCACCGTCCTGCATC AGGATTGGCTCAACGGCAAGGAGTACAAGTGCAAGGTGTCCAACAAGGGCCTG CCCTCCTCCATCGAGAAGACCATCTCCAAGGCTAAGGGCCAACCTCGGGAGCCC CAAGTGTATACCCTCCCTCCCAGCCAGGAGGAGATGACCAAGAATCAAGTGAG CCTGACCTGCCTCGTGAAGGGATTTTACCCCTCCGACATCGCTGTGGAATGGGA AAGCAATGGCCAACCTGAGAACAACTACAAGACCACACCCCCCGTGCTGGACT CCGATGGCTCCTTCTTCCTGTACAGCAGGCTGACCGTGGACAAATCCCGGTGGC AAGAGGGAAACGTGTTCAGCTGCTCCGTGATGCACGAGGCTCTCCACAACCACT ACACCCAGAAGAGCCTCTCCCTGAGCCTCGGCTAGTAA |
| 2D10.2B2 (murine; mIgG2A (LALAPG)) | 836 | CAGGTCCAGCTGCAGCAGTCTGGACCTGAGCTGGTGAAGCCTGGGGCTTCAGTG AAGATATCCTGCAAGGCTTCTGGCTACACCTTCACTGACTACTATATAAACTGG GTGAAGCAGAGGCCTGGACAGGGACTTGAGTGGATTGGATGGATTTATCCTGG AAGCAATGATACCAAGTACAATGAGAAGTTCAAGGGCAAGGCCACATTGACTG TAGACACATCCTCCAGCACGGCCTACATGCAGCTCGGCAGCCTGACCTCTGAGG ACTCTGCGGTCTATTTCTGTGCGAATTACTTCGGTTGTAGCGGGTGGTTCTTCGA TGTCTGGGGCACAGGGACCACAGTCACCGTCTCCTCAGCTAAGACTACTCCTCC CAGTGTCTACCCCCTGGCCCCCGTGTGCGGCGACACAACAGGCTCCTCCGTGAC ACTGGGCTGCCTGGTGAAAGGCTACTTCCCCGAGCCCGTGACACTGACATGGAA CTCCGGCTCCCTGTCCTCCGGCGTGCACACATTCCCCGCCGTGCTGCAGTCCGA CCTGTACACACTGTCCTCCTCCGTGACAGTGACATCCTCCACATGGCCCTCCCA GTCCATCACATGCAACGTGGCCCACCCCGCCTCCTCCACAAAAGTGGACAAAA AAATCGAGCCCAGGGGCCCCACAATCAAACCCTGCCCCCCCTGCAAATGCCCC GCCCCCAACGCCGCCGGCGGCCCCTCCGTGTTCATCTTCCCCCCAAAATCAAA GACGTGCTGATGATCTCCCTGTCCCCCATCGTGACATGCGTGGTGGTGGACGTG TCCGAGGACGACCCCGACGTGCAGATCTCCTGGTTCGTGAACAACGTGGAGGT GCACACAGCCCAGACACAGACACACAGGGAGGACTACAACTCCACACTGAGGG TGGTGTCCGCCCTGCCCATCCAGCACCAGGACTGGATGTCCGGCAAAGAGTTCA AATGCAAAGTGAACAACAAAGACCTGGGCGCCCCCATCGAGAGGACAATCTCC AAACCCAAAGGCTCCGTGAGGGCCCCCCAGGTGTACGTGCTGCCCCCCCCCGA GGAGGAGATGACAAAAAAACAGGTGACATGCATGATTGACGGATTCTA TGCCCGAGGACATCTACGTGGAGTGGACAAACAACGGCAAAACAGAGCTGAAC TACAAAAACACAGAGCCCGTGCTGGACTCCGACGGCTCCTACTTCATGTACTCC AAACTGAGGGTGGAGAAAAAAAACTGGGTGGAGAGGAACTCCTACTCCTGCTC CGTGGTGCACGAGGGCCTGCACAACCACCACAACAAAATCCTTCTCCAGGA CACCCGGCAAATAGTAA |

Figure 31 cont.

| Antibody | SEQ ID NO: | LC nucleic acid sequence |
|---|---|---|
| TB001 (IMT001; IMT001-4) | 750 | GACATCGTGCTGACCCAGTCTCCACTGAGCCTGCCTGTTACACCTGGCGAGCCAGC CTCCATCTCCTGCAGATCCTCTAAGTCCCTGCTGTACAAGGACGGCAAGACCTACC TGAACTGGTTCCTGCAGAAGCCCGGCCAGTCTCCTCAGCTCCTGATCTACCTGATG AGCACCCATGCCTCTGGCGTGCCCGATAGATTTTCCGGCTCTGGCTCTGGCACCGA CTTCACCCTGAAGATCTCCAGAGTGGAAGCCGAGGACGTGGGCGTGTACTACTGTC AGCAGCTGGTGGACTACCCTCTGACCTTTGGCGGCGGAACAAAGCTGGAAATCAA GCGGACAGTGGCCGCTCCTTCCGTGTTCATCTTCCCACCTTCCGACGAGCAGCTGA AGTCCGGCACAGCTTCTGTCGTGTGCCTGCTGAACAACTTCTACCCTCGGGAAGCC AAGGTGCAGTGGAAGGTGGACAATGCCCTGCAGTCCGGCAACTCCCAAGAGTCTG TGACCGAGCAGGACTCCAAGGACAGCACCTACAGCCTGTCCTCCACACTGACCCTG TCCAAGGCCGACTACGAGAAGCACAAGGTGTACGCCTGCGAAGTGACCCATCAGG GCCTGTCTAGCCCTGTGACCAAGTCTTTCAACCGGGGCGAGTGCTGATGA |
| TB006 (4A11.H3L1; IMT006; IMT006a) | 751 | GATATAGTGATGACCCAAACACCTTTGTCCCTGTCAGTCACCCCAGGCCAACCCGC ATCTATCTCATGCAAATCCTCAAAAAGTCTTTTGCACTCTGACGGGATAACATATCT CTACTGGTATCTTCAAAAACCTGGTCAGTCCCCCCAGCTCTTGATCTATAGAATGA GTAACCTTGCCTCTGGTGTCCCCGACCGGTTTAGTGGAAGCGGGTCTGGGACCGAC TTCACCCTCAAGATTAGTCGCGTCGAAGCCGAAGATGTGGGAGTGTATTACTGTGC CCAGATGCTCGAATTTCCCCTGACATTTGGTCAAGGAACTAAATTGGAGATTAAGC GGACCGTGGCCGCCCCCAGCGTGTTCATCTTCCCTCCCAGCGACGAGCAGCTGAAG TCTGGCACCGCCAGCGTGGTGTGCCTGCTGAACAACTTCTACCCCGCGAGGCCAA GGTGCAGTGGAAGGTGGACAACGCCCTGCAGAGCGGCAACAGCCAGGAGAGCGT GACCGAGCAGGACTCCAAGGACAGCACCTACAGCCTGAGCAGCACCCTGACCCTG AGCAAGGCCGACTACGAGAAGCACAAGGTGTACGCCTGCGAGGTGACCCACCAGG GACTGTCTAGCCCCGTGACCAAGAGCTTCAACCGGGGCGAGTGCTAA |
| 12G5.D7 | 752 | GACATCCTGATGACCCAATCTCCATCCTCCATGTCTGTATCTCTGGGAGACACAGT CAGCATCACTTGCCATGCAAGTCAGGGCATTAACTCTAATATGGGGTGGTTGCAGC AGAAACCAGGGAAATCATTTAAGGGCCTGATCTATCATGCAACCAACTTGGAAGA TGGAGTTCCATCAAGGTTCAGTGGCAGTGGATCTGGAGCAGATTATTCTCTCACCA TCAGCAGCCTGGAATCTGAAGATTTTGCAGACTATTACTGTGTACAGTATGCTCAG TTTCCTCCTACGTTCGGATCGGGGACCAAGCTGGAAATAAAACGGACCGTGGCCGC CCCCAGCGTGTTCATCTTCCCTCCCAGCGACGAGCAGCTGAAGTCTGGCACCGCCA GCGTGGTGTGCCTGCTGAACAACTTCTACCCCGCGAGGCCAAGGTGCAGTGGAA GGTGGACAACGCCCTGCAGAGCGGCAACAGCCAGGAGAGCGTGACCGAGCAGGA CTCCAAGGACAGCACCTACAGCCTGAGCAGCACCCTGACCCTGAGCAAGGCCGAC TACGAGAAGCACAAGGTGTACGCCTGCGAGGTGACCCACCAGGGACTGTCTAGCC CCGTGACCAAGAGCTTCAACCGGGGCGAGTGCTAA |
| 13A12.2E5 | 753 | GATGTTGTGATGACCCAGACTCCACTCACTTTGTCGGTTGCCATTGGACAACCAGC TTCCATCTCTTGCAAGTCGAGTCAGAGCCTCTTATATACTAATGGAAAAACCTATTT GAATTGGTTATTACAGAGGCCAGGCCAGTCTCCAAAACGCCTAATCTATCTGCTGT CTAAATTGGACTCTGGAGTCCCTGACAGGTTCAGTGCCAGTGGATCAGGGACAGAT TTCACACTGAAAATCAGCAGAGTGGAGGCTGAGGATTTGGGAGTTTATTACTGCTT GCAGAGTACACATTTTCCGCTCACGTTCGGTGCTGGGACCAAGCTGGAGATGAAAC GGACCGTGGCCGCCCCCAGCGTGTTCATCTTCCCTCCCAGCGACGAGCAGCTGAAG TCTGGCACCGCCAGCGTGGTGTGCCTGCTGAACAACTTCTACCCCGCGAGGCCAA GGTGCAGTGGAAGGTGGACAACGCCCTGCAGAGCGGCAACAGCCAGGAGAGCGT GACCGAGCAGGACTCCAAGGACAGCACCTACAGCCTGAGCAGCACCCTGACCCTG AGCAAGGCCGACTACGAGAAGCACAAGGTGTACGCCTGCGAGGTGACCCACCAGG GACTGTCTAGCCCCGTGACCAAGAGCTTCAACCGGGGCGAGTGCTAA |

Figure 32

| Antibody | SEQ ID NO: | LC nucleic acid sequence |
|---|---|---|
| 14H10.2C9 | 754 | GATGTTGTGATGACCCAGACTCCACTCACTTTGTCGGTTACCATTGGACAACCAGC CTCCATCTCTTGCAAGTCAAGTCAGAGCCTCTTCGATAGTGATGGAAAGACATATT TGAATTGGTTGTTACAGAGGCCAGGCCAGTCTCCAAAGCGCCTAATCTATCTGGTG TCTAAACTGGACTCTGGAGTCCCTGACAGGTTCACTGGCAGTGGATCAGGGACAGA TTTCACACTGAAAATCAGCAGAGTGGAGGCTGAGGATTTGGGAGTTTATTATTGCT GGCAAGGTACACATTTTCCTCTCACGTTCGGTGCTGGGACCAAGCTGGAAATGAAA CGGACCGTGGCCGCCCCAGCGTGTTCATCTTCCCTCCCAGCGACGAGCAGCTGAA GTCTGGCACCGCCAGCGTGGTGTGCCTGCTGAACAACTTCTACCCCGCGAGGCCA AGGTGCAGTGGAAGGTGGACAACGCCCTGCAGAGCGGCAACAGCCAGGAGAGCG TGACCGAGCAGGACTCCAAGGACAGCACCTACAGCCTGAGCAGCACCCTGACCCT GAGCAAGGCCGACTACGAGAAGCACAAGGTGTACGCCTGCGAGGTGACCCACCAG GGACTGTCTAGCCCCGTGACCAAGAGCTTCAACCGGGGCGAGTGCTAA |
| 15F10.2D6 | 755 | GATGTTTTGATGACCCAAACTCCACTCTCCCTGCCTGTCAGTCTTGGAGATCAAGCC TCCATCTCTTGCAGATCTAGTCAGAGCATTGTACATAATAATGGAAACACCTATTT AGAATGGTACCTGCAGAAACCAGGCCAGTCTCCAAAACTCCTGATCTACAAAGTTT CCAACCGATTTTCTGGGGTCCCAGACAGGTTCAGTGGCAGTGGATCAGGGACAGAT TTCACACTCAAGATCAGCAGAGTGGAGGCTGAGGATCTGGGAGTTTATTACTGCTT TCAAGGTTCACATGTTCCGCTCACGTTCGGTGGTGGGACCAAGTTGGAGCTGAAAC GGACCGTGGCCGCCCCAGCGTGTTCATCTTCCCTCCCAGCGACGAGCAGCTGAAG TCTGGCACCGCCAGCGTGGTGTGCCTGCTGAACAACTTCTACCCCGCGAGGCCAA GGTGCAGTGGAAGGTGGACAACGCCCTGCAGAGCGGCAACAGCCAGGAGAGCGT GACCGAGCAGGACTCCAAGGACAGCACCTACAGCCTGAGCAGCACCCTGACCCTG AGCAAGGCCGACTACGAGAAGCACAAGGTGTACGCCTGCGAGGTGACCCACCAGG GACTGTCTAGCCCCGTGACCAAGAGCTTCAACCGGGGCGAGTGCTAA |
| 19B5.2E6 | 756 | GATATACAAATGACTCAAACTACCTCTTCTCTTTCCGCATCTTTGGGTGATCGGGTC ACTATATCCTGCTCCGCCTCTCAAGGCATAAACAATTACCTGAATTGGTATCAGCA AAAACCAGACGGAACTGTAAAATTGCTTATCTACTACGCTTCAAGTCTGCATAGTG GGGTTCCCAGCAGATTTTCCGGTTCCGGGTCCGGCACTGATTATTCTCTCACAATTA GTAACCTGGAACCTGAGGACATTGCAACTTATTACTGTCAACAATACAGTCAGGTA CCTTACACTTTCGGATCAGGAACAAAGTTGGAAATCAAGAGGACCGTGGCCGCCC CCAGCGTGTTCATCTTCCCTCCCAGCGACGAGCAGCTGAAGTCTGGCACCGCCAGC GTGGTGTGCCTGCTGAACAACTTCTACCCCGCGAGGCCAAGGTGCAGTGGAAGGT GGACAACGCCCTGCAGAGCGGCAACAGCCAGGAGAGCGTGACCGAGCAGGACTCC AAGGACAGCACCTACAGCCTGAGCAGCACCCTGACCCTGAGCAAGGCCGACTACG AGAAGCACAAGGTGTACGCCTGCGAGGTGACCCACCAGGGACTGTCTAGCCCCGT GACCAAGAGCTTCAACCGGGGCGAGTGCTAA |
| 20D11.2C6 | 757 | GACATCCAGATGAACCAGTCTCCATCCAGTCTGTCTGCATCCCTCGGAGACACAAT TACCATCACTTGCCGTGCCAGTCAGAACATTTATATTTGGTTAAGTTGGTACCAGC AGAAACCAGGAAATATTCCTAAACTCTTGATCTATAAGGCTTCCAACTTGCACACA GGCGTCCCATCAAGGTTTAGTGGCAGTGGATCTGGAACAGATTTCACATTAACCAT CAGCACTCTGCAGCCTGAAGACATTGCCACTTACTTCTGTCTCCAGGGTCAAAGTT ATCCTCTCACGTTCGGTGCTGGGACCAAGCTGGAGATGAAACGGACCGTGGCCGCC CCAGCGTGTTCATCTTCCCTCCCAGCGACGAGCAGCTGAAGTCTGGCACCGCCAG CGTGGTGTGCCTGCTGAACAACTTCTACCCCGCGAGGCCAAGGTGCAGTGGAAG GTGGACAACGCCCTGCAGAGCGGCAACAGCCAGGAGAGCGTGACCGAGCAGGACT CCAAGGACAGCACCTACAGCCTGAGCAGCACCCTGACCCTGAGCAAGGCCGACTA CGAGAAGCACAAGGTGTACGCCTGCGAGGTGACCCACCAGGGACTGTCTAGCCCC GTGACCAAGAGCTTCAACCGGGGCGAGTGCTAA |

Figure 32 cont.

| Antibody | SEQ ID NO: | LC nucleic acid sequence |
|---|---|---|
| 20H5.A3 | 758 | GATATCCAGATGACACAGACTACATCCTCCCTGTCTGCCTCTCTGGGAGACAGAGT CACCATCAATTGCAGTGCAAGTCAGGACATTAGCAATTATTTAAACTGGTATCAGC AGAAACCAGATGGAACTGTTAAACTCCTGATCTATTACACATCAAGTTTACTCTCA GGAGTCCCATCAAGGTTCAGTGGCAGTGGGTCTGGGACAGATTATTCTCTCACCAT CAGCAACCTGGAACCTGAAGATATTGCCACTTACTTTGTCAGCAATATAGTAAGC TTCCCTATACGTTCGGATCGGGGACCCACCTGGAAATAAAACGGACCGTGGCCGCC CCCAGCGTGTTCATCTTCCCTCCCAGCGACGAGCAGCTGAAGTCTGGCACCGCCAG CGTGGTGTGCCTGCTGAACAACTTCTACCCCGCGAGGCCAAGGTGCAGTGGAAG GTGGACAACGCCCTGCAGAGCGGCAACAGCCAGGAGAGCGTGACCGAGCAGGACT CCAAGGACAGCACCTACAGCCTGAGCAGCACCCTGACCCTGAGCAAGGCCGACTA CGAGAAGCACAAGGTGTACGCCTGCGAGGTGACCCACCAGGGACTGTCTAGCCCC GTGACCAAGAGCTTCAACCGGGGCGAGTGCTAA |
| 23H9.2E4 | 759 | GATATCCAGATGACACAGACTACATCCTCCCTGTCTGCCTCTCTGGGAGACAGAGT CACCATCAGTTGCAGTGCAAGTCAGGGCATTAACAATTATTTAAACTGGTATCAGC AGAAACCAGATGGAACTGTTAAACTCCTGATCTATTACGCATCAAGTTTACACTCA GGAGTCCCATCAAGGTTCAGTGGCAGTGGGTCTGGGACAGATTATTCTCTCACCAT CAGCAACCTGGAACCTGAAGATATTGCCACTTACTATTGTCAGCAGTATAGTCAGG TTCCGTATACGTTCGGATCGGGGACCAAGTTGGAAATAAAACGGACCGTGGCCGC CCCCAGCGTGTTCATCTTCCCTCCCAGCGACGAGCAGCTGAAGTCTGGCACCGCCA GCGTGGTGTGCCTGCTGAACAACTTCTACCCCGCGAGGCCAAGGTGCAGTGGAA GGTGGACAACGCCCTGCAGAGCGGCAACAGCCAGGAGAGCGTGACCGAGCAGGA CTCCAAGGACAGCACCTACAGCCTGAGCAGCACCCTGACCCTGAGCAAGGCCGAC TACGAGAAGCACAAGGTGTACGCCTGCGAGGTGACCCACCAGGGACTGTCTAGCC CCGTGACCAAGAGCTTCAACCGGGGCGAGTGCTAA |
| 2D10-VH0-VL0 | 760 | GACATAGTAATGACACAGGCCGCATTTAGCAATCCAGTAACCTTGGGCACATCCGC CTCCATATCTTGCAGGTCATCCAAAAGCTTGCTGCACTCTGACGGTATTACTTACCT GTACTGGTATTTGCAGCGACCTGGGCAATCCCCTCAACTCCTGATTTACCGCATGA GCAACCTGGCCTCAGGGGTGCCTGACCGCTTTTCAGGATCAGGGAGCGGCACTGAC TTCACCTTGCGAATCAGCAGAGTAGAAGCAGAGGATGTTGGAGTTTACTACTGTGC CCAGATGATCGAATTTCCACTTACTTTGGGGCCGGGACCATTCTGGAGCTTAAAC GGACCGTGGCCGCCCCCAGCGTGTTCATCTTCCCTCCCAGCGACGAGCAGCTGAAG TCTGGCACCGCCAGCGTGGTGTGCCTGCTGAACAACTTCTACCCCGCGAGGCCAA GGTGCAGTGGAAGGTGGACAACGCCCTGCAGAGCGGCAACAGCCAGGAGAGCGT GACCGAGCAGGACTCCAAGGACAGCACCTACAGCCTGAGCAGCACCCTGACCCTG AGCAAGGCCGACTACGAGAAGCACAAGGTGTACGCCTGCGAGGTGACCCACCAGG GACTGTCTAGCCCCGTGACCAAGAGCTTCAACCGGGGCGAGTGCTAA |
| 3B11.2G2 | 761 | GATGTTGTGATGACCCAGACTCCACTCACTTTGTCGGTTGCCATTGGACAACCAGC TTCCATCTCTTGCAAGTCGAGTCAGAGCCTCTTATATACTAATGGAAAAACCTATTT GAATTGGTTATTACAGAGGCCAGGCCAGTCTCCAAAACGCCTAATCTATCTGGTGT CTAAATTGGACTCTGGAGTCCCTGACAGGTTCAGTGGCAGTGGATCAGGGACAGAT TTCACACTGAAAATCAGCAGAGTGGAGGCTGAGGATTTGGAGTTTATTACTGCTT GCAGAGTACACATTTTCCGCTCACGTTCGGTGCTGGGACCAAGCTGGAGCTGAAAC GGACCGTGGCCGCCCCCAGCGTGTTCATCTTCCCTCCCAGCGACGAGCAGCTGAAG TCTGGCACCGCCAGCGTGGTGTGCCTGCTGAACAACTTCTACCCCGCGAGGCCAA GGTGCAGTGGAAGGTGGACAACGCCCTGCAGAGCGGCAACAGCCAGGAGAGCGT GACCGAGCAGGACTCCAAGGACAGCACCTACAGCCTGAGCAGCACCCTGACCCTG AGCAAGGCCGACTACGAGAAGCACAAGGTGTACGCCTGCGAGGTGACCCACCAGG GACTGTCTAGCCCCGTGACCAAGAGCTTCAACCGGGGCGAGTGCTAA |

Figure 32 cont.

| Antibody | SEQ ID NO: | LC nucleic acid sequence |
|---|---|---|
| 7D8.2D8 | 762 | GATGTTTTGATGACCCAAACTCCACTCTCCCTGCCTGTCAGTCTTGGAGATCAAGCC<br>TCCATCTCTTGCAGATCTAGTCAGAGCATTGTACATAGTAATGGAAACACCTATTT<br>AGAATGGTACCTGCAGAAACCAGGCCAGTCTCCAAAGCTCCTGATCTACAAAGTTT<br>CCAACCGATTTTCTGGGGTCCCAGACAGGTTCAGTGGCAGTGGATCAGGGACAGAT<br>TTCACACTCAAGATCAGCAGAGTGGAGGCTGAGGATCTGGGAGTTTATTACTGCTT<br>TCAAGGTTCACATGTTCCGCTCACGTTCGGTGCTGGGACCAAGCTGGAGCTGAAAC<br>GGACCGTGGCCGCCCCAGCGTGTTCATCTTCCCTCCCAGCGACGAGCAGCTGAAG<br>TCTGGCACCGCCAGCGTGGTGTGCCTGCTGAACAACTTCTACCCCGCGAGGCCAA<br>GGTGCAGTGGAAGGTGGACAACGCCCTGCAGAGCGGCAACAGCCAGGAGAGCGT<br>GACCGAGCAGGACTCCAAGGACAGCACCTACAGCCTGAGCAGCACCCTGACCCTG<br>AGCAAGGCCGACTACGAGAAGCACAAGGTGTACGCCTGCGAGGTGACCCACCAGG<br>GACTGTCTAGCCCCGTGACCAAGAGCTTCAACCGGGGCGAGTGCTAA |
| mTB001 (mIMT001) | 763 | GATATTGTTATTACTCAGGATGAGCTTAGTAATCCTGTCACTAGCGGGGAAAGTGT<br>TAGTATCAGTTGTCGTTCATCCAAGTCACTCCTCTACAAAGACGGCAAGACTTATC<br>TCAACTGGTTTCTTCAACGACCCGGTCAATCTCCACAGCTCCTGATTTACCTGATGT<br>CAACTCACGCTTCTGGTGTTAGCGACCGTTTCTCCGGAAGTGGCTCCGGGACAGAC<br>TTCACTCTTGAAATCTCACGTGTAAAAGCAGAGGACGTAGGTGTCTATTATTGTCA<br>ACAGCTTGTGGACTACCCCTTGACCTTTGGCGCTGGCACAAAGCTGGAACTGAAGC<br>GTGCTGATGTTGCCCCTACTGTGTCCATCTTCCCCCCCTCCTCCGAGCAGCTGACAT<br>CCGGCGGCGCCTCCGTGGTGTGCTTCCTGAACAACTTCTACCCCAAAGACATCAAC<br>GTGAAATGGAAAATCGACGGCTCCGAGAGGCAGAACGGCGTGCTGAACTCCTGGA<br>CAGACCAGGACTCCAAAGACTCCACATACTCCATGTCCTCCACACTGACACTGACA<br>AAAGACGAGTACGAGAGGCACAACTCCTACACATGCGAGGCCACACACAAACAT<br>CCACATCCCCCATCGTGAAATCCTTCAACAGGAACGAGTGCTAATAA |
| 4A11.2B5 | 764 | GACATTGTGATGACTCAGGCAGCCTTTTCCAACCCTGTAACACTTGGAACTAGTGC<br>CTCCATCTCATGCCGTTCCAGCAAGAGTCTTTTGCACAGCGATGGGATAACCTATC<br>TCTATTGGTATCTGCAACGACCCGGTCAGTCACCCCAACTTCTTATCTATGAATGT<br>CTAACTTGGCCTCCGGCGTGCCCGACCGCTTTTCCGGGAGTGGGAGCGGTACAGAT<br>TTCACCTTGCGAATTTCCCGGGTTGAGGCAGAGGACGTAGGTGTCTACTATTGTGC<br>TCAGATGCTTGAGTTTCCTCTCACTTTCGGAGCCGGCACCAAACTGGAACTGAAAC<br>GGACCGTGGCCGCCCCAGCGTGTTCATCTTCCCTCCCAGCGACGAGCAGCTGAAG<br>TCTGGCACCGCCAGCGTGGTGTGCCTGCTGAACAACTTCTACCCCGCGAGGCCAA<br>GGTGCAGTGGAAGGTGGACAACGCCCTGCAGAGCGGCAACAGCCAGGAGAGCGT<br>GACCGAGCAGGACTCCAAGGACAGCACCTACAGCCTGAGCAGCACCCTGACCCTG<br>AGCAAGGCCGACTACGAGAAGCACAAGGTGTACGCCTGCGAGGTGACCCACCAGG<br>GACTGTCTAGCCCCGTGACCAAGAGCTTCAACCGGGGCGAGTGCTAA |
| 4A11.H1L1 (IMT006b) | 765 | GATATAGTGATGACCCAAACACCTTTGTCCCTGTCAGTCACCCCAGGCCAACCCGC<br>ATCTATCTCATGCAAATCCTCAAAAAGTCTTTTGCACTCTGACGGGATAACATATCT<br>CTACTGGTATCTTCAAAAACCTGGTCAGTCCCCCAGCTCTTGATCTATAGAATGA<br>GTAACCTTGCCTCTGGTGTCCCCGACCGGTTTAGTGGAAGCGGGTCTGGGACCGAC<br>TTCACCCTCAAGATTAGTCGCGTCGAAGCCGAAGATGTGGGAGTGTATTACTGTGC<br>CCAGATGCTCGAATTTCCCCTGACATTTGGTCAAGGAACTAAATTGGAGATTAAGC<br>GGACCGTGGCCGCCCCAGCGTGTTCATCTTCCCTCCCAGCGACGAGCAGCTGAAG<br>TCTGGCACCGCCAGCGTGGTGTGCCTGCTGAACAACTTCTACCCCGCGAGGCCAA<br>GGTGCAGTGGAAGGTGGACAACGCCCTGCAGAGCGGCAACAGCCAGGAGAGCGT<br>GACCGAGCAGGACTCCAAGGACAGCACCTACAGCCTGAGCAGCACCCTGACCCTG<br>AGCAAGGCCGACTACGAGAAGCACAAGGTGTACGCCTGCGAGGTGACCCACCAGG<br>GACTGTCTAGCCCCGTGACCAAGAGCTTCAACCGGGGCGAGTGCTAA |

Figure 32 cont.

| Antibody | SEQ ID NO: | LC nucleic acid sequence |
|---|---|---|
| 4A11.H4L2 (IMT006c) | 766 | GATATTGTAATGACCCAAAGCCCCCTGTCCTTGCCTGTTACCCCAGGTGAGCCTGC<br>CAGCATATCTTGCCGATCCAGTAAATCTCTGCTTCATAGCGATGGCATCACCTATTT<br>GTATTGGTATTTGCAGAAGCCCGGCCAGAGCCCCCAGTTGCTGATCTACAGAATGT<br>CCAACCTTGCTAGTGGAGTGCCCGACCGGTTTAGCGGTTCAGGCTCAGGGACTGAT<br>TTCACTCTTAAAATCAGTAGGGTAGAGGCCGAAGACGTTGGTGTATATTATTGTGC<br>TCAGATGTTGGAGTTTCCACTCACATTTGGACAAGGTACAAAGCTGGAAATTAAGC<br>GGACCGTGGCCGCCCCAGCGTGTTCATCTTCCCTCCCAGCGACGAGCAGCTGAAG<br>TCTGGCACCGCCAGCGTGGTGTGCCTGCTGAACAACTTCTACCCCGCGAGGCCAA<br>GGTGCAGTGGAAGGTGGACAACGCCCTGCAGAGCGGCAACAGCCAGGAGAGCGT<br>GACCGAGCAGGACTCCAAGGACAGCACCTACAGCCTGAGCAGCACCCTGACCCTG<br>AGCAAGGCCGACTACGAGAAGCACAAGGTGTACGCCTGCGAGGTGACCCACCAGG<br>GACTGTCTAGCCCCGTGACCAAGAGCTTCAACCGGGGCGAGTGCTAA |
| 4G2.2G6 | 767 | GATGTCGTAATGACTCAAACCCCCCTGACCCTTAGTGTTACTATAGGCCAGCCCGC<br>AAGCATCTCCTGCAAATCCTCCCAGTCTCTTCTTTATACTGATGGCAAAACCTACTT<br>GTCCTGGTTTTTGCAGCGCCCAGGTCAAAGTCCTAAACGTCTTATTTACTTGGTCTC<br>TAAACTCGATTCCGGCGTGCCTGACCGGTTCTCCGGTAGCGGTAGCGGTACCGATT<br>TCACTTTGAAGATTAGCCGAGTTGAGGCAGAAGACCTCGGGGTCTACTACTGCCTT<br>CAGAGTACACACTTCCCACTTACATTTGGCGCAGGAACCAAGTTGGAGGTTAAACG<br>GACCGTGGCCGCCCCAGCGTGTTCATCTTCCCTCCCAGCGACGAGCAGCTGAAGT<br>CTGGCACCGCCAGCGTGGTGTGCCTGCTGAACAACTTCTACCCCGCGAGGCCAAG<br>GTGCAGTGGAAGGTGGACAACGCCCTGCAGAGCGGCAACAGCCAGGAGAGCGTG<br>ACCGAGCAGGACTCCAAGGACAGCACCTACAGCCTGAGCAGCACCCTGACCCTGA<br>GCAAGGCCGACTACGAGAAGCACAAGGTGTACGCCTGCGAGGTGACCCACCAGGG<br>ACTGTCTAGCCCCGTGACCAAGAGCTTCAACCGGGGCGAGTGCTAA |
| 6B3.2D3 | 768 | AGTATTGTGATGACCCAGACTCCCAAATTCCTGCTTGTATCAGCAGGAGACAGGGT<br>TACCATAACCTGCAAGGCCAGTCAGAGTGTGAGTAATGATGTAGCTTGGTACCAAC<br>AGAAGCCAGGGCAGTCTCCTAAATTGTTGATATATTATGCATCCAATCGCTACACT<br>GGAGTCCCTGATCGCTTCACTGGCAGTGGATATGGGACGGATTTCACTTTCACCAT<br>CAGCACTGTGCAGGCTGAAGACCTGGCAGTTTATTTCTGTCAGCAGGATTATACCT<br>CTCCGTACACGTTCGGAGGGGGGACCAAGCTGGAAATAAAACGGACCGTGGCCGC<br>CCCCAGCGTGTTCATCTTCCCTCCCAGCGACGAGCAGCTGAAGTCTGGCACCGCCA<br>GCGTGGTGTGCCTGCTGAACAACTTCTACCCCGCGAGGCCAAGGTGCAGTGGAA<br>GGTGGACAACGCCCTGCAGAGCGGCAACAGCCAGGAGAGCGTGACCGAGCAGGA<br>CTCCAAGGACAGCACCTACAGCCTGAGCAGCACCCTGACCCTGAGCAAGGCCGAC<br>TACGAGAAGCACAAGGTGTACGCCTGCGAGGTGACCCACCAGGGACTGTCTAGCC<br>CCGTGACCAAGAGCTTCAACCGGGGCGAGTGCTAA |
| 6H6.2D6 | 769 | GACATCCAGATGACCCAGACCACCTCCTCCCTGTCCGCCTCCCTGGGCGACAGGGT<br>GACCATCTCCTGCTCCGCCTCCCAGGGCATCTCCAACTACCTGAACTGGTACCAGC<br>AGAAGCCCGACGGCACCGTGAAGCTGCTGATCTACTACACCTCCTCCCTGCACTCC<br>GGCGTGCCCTCCAGGTTCTCCGGCTCCGGCTCCGGCACCGACTACTCCCTGACCAT<br>CTCCAACCTGGAGCCCGAGGACATCGCCACCTACTACTGCCAGCAGTACTCCGAGC<br>TGCCCTACACCTTCGGCTCCGGCACCAAGCTGGAGATCAAGAGGACCGTGGCCGCC<br>CCCAGCGTGTTCATCTTCCCTCCCAGCGACGAGCAGCTGAAGTCTGGCACCGCCAG<br>CGTGGTGTGCCTGCTGAACAACTTCTACCCCGCGAGGCCAAGGTGCAGTGGAAG<br>GTGGACAACGCCCTGCAGAGCGGCAACAGCCAGGAGAGCGTGACCGAGCAGGACT<br>CCAAGGACAGCACCTACAGCCTGAGCAGCACCCTGACCCTGAGCAAGGCCGACTA<br>CGAGAAGCACAAGGTGTACGCCTGCGAGGTGACCCACCAGGGACTGTCTAGCCCC<br>GTGACCAAGAGCTTCAACCGGGGCGAGTGCTAA |

Figure 32 cont.

| Antibody | SEQ ID NO: | LC nucleic acid sequence |
|---|---|---|
| 9H2.2H10 | 770 | GACATTGTGATGACCCAGTCTCACAAATTCATGTCCACATCAGTAGGAGACAGGGTCAGCATCACCTGCAAGGCCAGTCAGGATGTGAGTACTGCTGTAGCCTGGTATCAACAAAAACCAGGGCAATCTCCTAAACTACTGATTTACTGGGCATCCACCCGGCACACTGGAGTCCCTGATCGCTTCACAGGCAGTGGATCTGGGACAGATTATACTCTCACCATCAGCAGTGTGCAGGCTGAAGACCTGGCACTTTATTACTGTCAGCAACATTATACCACTCCGCTCACGTTCGGTGCTGGGACCAAGCTGGAGCTGAAACGGACCGTGGCCGCCCCCAGCGTGTTCATCTTCCCTCCCAGCGACGAGCAGCTGAAGTCTGGCACCGCCAGCGTGGTGTGCCTGCTGAACAACTTCTACCCCGCGAGGCCAAGGTGCAGTGGAAGGTGGACAACGCCCTGCAGAGCGGCAACAGCCAGGAGAGCGTGACCGAGCAGGACTCCAAGGACAGCACCTACAGCCTGAGCAGCACCCTGACCCTGAGCAAGGCCGACTACGAGAAGCACAAGGTGTACGCCTGCGAGGTGACCCACCAGGGACTGTCTAGCCCCGTGACCAAGAGCTTCAACCGGGGCGAGTGCTAA |
| 13G4.2F8 | 771 | GACATTGTGATGACCCAGTCTCAAAAATTCATGTCCACATCAGTAGGAGAGAGGGTCAGCATCACCTGCAAGGCCAGTCAGAATGTAGGTACTAATGTAGCCTGGTATCAGCAGAAAGCAGGGCAGTCTCTTGAACTGCTGATCTATGGGGCATCCAACCGGCACACTGGAGTCCCTGATCGCTTCACAGGCAGTGGATCTGGGACAGATTTCACTCTCACCATCACCAATGTGCAGTCTGAAGACATGACAAATTATTTCTGTGAGCAATATAGCAACTTTCCTCTCACGTTCGGTGCTGGGACCAAGCTGGAGCTGAAACGGACCGTGGCCGCCCCCAGCGTGTTCATCTTCCCTCCCAGCGACGAGCAGCTGAAGTCTGGCACCGCCAGCGTGGTGTGCCTGCTGAACAACTTCTACCCCGCGAGGCCAAGGTGCAGTGGAAGGTGGACAACGCCCTGCAGAGCGGCAACAGCCAGGAGAGCGTGACCGAGCAGGACTCCAAGGACAGCACCTACAGCCTGAGCAGCACCCTGACCCTGAGCAAGGCCGACTACGAGAAGCACAAGGTGTACGCCTGCGAGGTGACCCACCAGGGACTGTCTAGCCCCGTGACCAAGAGCTTCAACCGGGGCGAGTGCTAA |
| 13H12.2F8 | 772 | GACGTTGTTATGACACAAACACCACTTACACTTTCTGTAACTATCGGTCAGCCTGCCTCAATTTCATGTAAGTCTTCTCAGTCCCTGTTTCATAGCGACGGGAAGACTTACCTGAATTGGCTTCTCCAACGACCAGGCCAATCACCCAAGCGCCTTATTTATTTGGTCAGTAAATTGGACAGTGGAGTTCCCGATAGATTTACCGGGAGCGGTTCTGGGACCGATTTCACCCCAAAGATCTCCAGGGTAGAAGACGAAGATCTCGGTGTGTACTATTGCTGGCAGGGGACACATTTCCCTCTGACATTCGGTGCTGGAACCAAACTTGAGATGAAACGGACCGTGGCCGCCCCCAGCGTGTTCATCTTCCCTCCCAGCGACGAGCAGCTGAAGTCTGGCACCGCCAGCGTGGTGTGCCTGCTGAACAACTTCTACCCCGCGAGGCCAAGGTGCAGTGGAAGGTGGACAACGCCCTGCAGAGCGGCAACAGCCAGGAGAGCGTGACCGAGCAGGACTCCAAGGACAGCACCTACAGCCTGAGCAGCACCCTGACCCTGAGCAAGGCCGACTACGAGAAGCACAAGGTGTACGCCTGCGAGGTGACCCACCAGGGACTGTCTAGCCCCGTGACCAAGAGCTTCAACCGGGGCGAGTGCTAA |
| 15G7.2A7 | 773 | GACATCCAGATGAACCAGTCTCCATCCAGTCTGTCTGCATCCCTCGGAGACACAATTTCCATCACTTGCCGTGCCAGTCAGAACATTAATATTTGGTTAAGCTGGTACCAGCAGAAACCAGGAAATATTCCTCAACTATTGATCTATAAGGCTTCCAACTTGCACACAGGCGTCCCCTCAAGGTTTAGTGGCAGTGGATCTGGAACAGATTTCACATTAACCATCAGCAGTCTGCAGCCTGAAGACATTGCCACTTACTACTGTCTACAGGGTCAAAGTTATCCTCTCACGTTCGGTGCTGGGACCAAGCTGGTGATGAAACGGACCGTGGCCGCCCCCAGCGTGTTCATCTTCCCTCCCAGCGACGAGCAGCTGAAGTCTGGCACCGCCAGCGTGGTGTGCCTGCTGAACAACTTCTACCCCGCGAGGCCAAGGTGCAGTGGAAGGTGGACAACGCCCTGCAGAGCGGCAACAGCCAGGAGAGCGTGACCGAGCAGGACTCCAAGGACAGCACCTACAGCCTGAGCAGCACCCTGACCCTGAGCAAGGCCGACTACGAGAAGCACAAGGTGTACGCCTGCGAGGTGACCCACCAGGGACTGTCTAGCCCCGTGACCAAGAGCTTCAACCGGGGCGAGTGCTAA |

Figure 32 cont.

| Antibody | SEQ ID NO: | LC nucleic acid sequence |
|---|---|---|
| 19D9.2E5 | 774 | GATGTTGTGATGACCCAGACTCCACTCACTTTGTCGGTTACCATTGGACAACCAGC CTCCATCTCTTGTAAGTCAAGTCAGAGCCTCTTACATAGTGATGGAAAGACATATT TGAATTGGTTGTTACAGAGGCCAGGCCAGCCTCCAAAGCGCCTAATGTATCTGGTG TCTACACTGGACTCTGGAGTCCCTGACAGGTTCACTGGCAGTGGATCAGGGACAGA TTTCACACTGAAAATCAGCAGAGTGGAGGCTGAGGATTTGGGAGTTTATTATTGCT GGCAAGGTACACATTTTCCTCTCACGTTCGGTGCTGGGACCAAGCCGGAGCGGACC GTGGCCGCCCCCAGCGTGTTCATCTTCCCTCCCAGCGACGAGCAGCTGAAGTCTGG CACCGCCAGCGTGGTGTGCCTGCTGAACAACTTCTACCCCCGCGAGGCCAAGGTGC AGTGGAAGGTGGACAACGCCCTGCAGAGCGGCAACAGCCAGGAGAGCGTGACCG AGCAGGACTCCAAGGACAGCACCTACAGCCTGAGCAGCACCCTGACCCTGAGCAA GGCCGACTACGAGAAGCACAAGGTGTACGCCTGCGAGGTGACCCACCAGGGACTG TCTAGCCCCGTGACCAAGAGCTTCAACCGGGGCGAGTGCTAA |
| 23B10.2B12 | 775 | GATATTGTGATGACGCAGGCTGCATTCTCCAATCCAGTCACTCTTGGAACGTCAGC TTCCATCTCCTGCAGGTCTAGTAAGAGTCTCCTACATAGTGATGGCATCACTTATTT CTATTGGTATCTGCAGAGGCCAGGCCAGTCTCCTCAGCTCCTGATATATCGGATGT CCAACCTTGCCTCAGGAGTCCCAGACAGGTTCAGTGGCAGTGGGTCAGGAACTGAT TTCACACTGAGAATCAGCAGAGTGGAGGCTGAGGATGTGGGTGTTTATTACTGTGC TCAAATGCTAGAATTCCCGCTCACGTTCGGTGCTGGGACCAAGCTGGAGCGGACCG TGGCCGCCCCCAGCGTGTTCATCTTCCCTCCCAGCGACGAGCAGCTGAAGTCTGGC ACCGCCAGCGTGGTGTGCCTGCTGAACAACTTCTACCCCCGCGAGGCCAAGGTGCA GTGGAAGGTGGACAACGCCCTGCAGAGCGGCAACAGCCAGGAGAGCGTGACCGA GCAGGACTCCAAGGACAGCACCTACAGCCTGAGCAGCACCCTGACCCTGAGCAAG GCCGACTACGAGAAGCACAAGGTGTACGCCTGCGAGGTGACCCACCAGGGACTGT CTAGCCCCGTGACCAAGAGCTTCAACCGGGGCGAGTGCTAA |
| 24D12.2H9 | 776 | GACATTGTGATGACCCAGTCTCACAAATTCATGTCCACATCAGTAGGAGACAGGGT CAGCATCACCTGCAAGGCCAGTCAGGATGTGCGTACTGCTGTAGCCTGGTATCAAC AGAAACCAGGGCAATCTCCTAAACTACTGATTTACTGGGCATCCACCCGGCACACT GGAGTCCCTGATCGCTTCACAGGCAGTGGATCTGGGACAGATTTCACTCTCACCCT TAGCAATGTGCAGTCTGAAGACTTGGCAGATTATTTCTGTCAGCAATATAGTAGTT ATCCGTGGACGTTCGGTGGAGGCACCAAGCTGGAAATCAAACGGACCGTGGCCGC CCCCAGCGTGTTCATCTTCCCTCCCAGCGACGAGCAGCTGAAGTCTGGCACCGCCA GCGTGGTGTGCCTGCTGAACAACTTCTACCCCCGCGAGGCCAAGGTGCAGTGGAA GGTGGACAACGCCCTGCAGAGCGGCAACAGCCAGGAGAGCGTGACCGAGCAGGA CTCCAAGGACAGCACCTACAGCCTGAGCAGCACCCTGACCCTGAGCAAGGCCGAC TACGAGAAGCACAAGGTGTACGCCTGCGAGGTGACCCACCAGGGACTGTCTAGCC CCGTGACCAAGAGCTTCAACCGGGGCGAGTGCTAA |
| F846C.1B2 | 777 | AACATTTGGTTGACACAGTCGCCATCATCTCTGGCTGTGTCTGCAGGAGAAATGGT CACTATGACCTGTAAGTCCAGTCAAAGTGTTTTATACAGTTCAAATCAGAAGAACT ACTTGGCCTGGTACCAGCAGAAACCAGGGCAGTCTCCTAAACTGCTGATCTACTGG GCATCCACTAGGGAATCTGGTGTCCCTGATCGCTTCACAGGCAGTGGATCTGGGAC AGACTTTTCTCTTACCATCAGCAGTGTACAAGCTGAAGACCTGGCAGTTTATTACT GTCATCAATATCTCCTCGCTCACGTTCGGTGCTGGGACCAAGCTGGAGCTGAAA CGGACCGTGGCCGCCCCCAGCGTGTTCATCTTCCCTCCCAGCGACGAGCAGCTGAA GTCTGGCACCGCCAGCGTGGTGTGCCTGCTGAACAACTTCTACCCCCGCGAGGCCA AGGTGCAGTGGAAGGTGGACAACGCCCTGCAGAGCGGCAACAGCCAGGAGAGCG TGACCGAGCAGGACTCCAAGGACAGCACCTACAGCCTGAGCAGCACCCTGACCCT GAGCAAGGCCGACTACGAGAAGCACAAGGTGTACGCCTGCGAGGTGACCCACCAG GGACTGTCTAGCCCCGTGACCAAGAGCTTCAACCGGGGCGAGTGCTAA |

Figure 32 cont.

| Antibody | SEQ ID NO: | LC nucleic acid sequence |
|---|---|---|
| F846C.1F5 | 778 | AACATTATGATGACACAGTCGCCATCATCTCTGGCTGTGTCTGCAGGAGAAAAGGTCACTATGAGCTGTAAGTCCAGTCAAAGTGTTTTATACAGTTCAAATCAGAAGAACTACTTGGCCTGGTACCAGCAGAAACCAGGGCAGTCTCCTAAACTGCTGATCTACTGGGCATCCACTAGGGAATCTGGTGTCCCTGATCGCTTCACAGGCAGTGGATCTGGGACAGATTTTACTCTTACCATCAGCAGTGTACAACCTGAAGACCTGGCAGTTTATTACTGTCATCAATACCTCTCCTCGCTCACGTTCGGTGCTGGGACCAAGCTGGAGCTGAAACGGACCGTGGCCGCCCCAGCGTGTTCATCTTCCCTCCCAGCGACGAGCAGCTGAAGTCTGGCACCGCCAGCGTGGTGTGCCTGCTGAACAACTTCTACCCCGCGAGGCCAAGGTGCAGTGGAAGGTGGACAACGCCCTGCAGAGCGGCAACAGCCAGGAGAGCGTGACCGAGCAGGACTCCAAGGACAGCACCTACAGCCTGAGCAGCACCCTGACCCTGAGCAAGGCCGACTACGAGAAGCACAAGGTGTACGCCTGCGAGGTGACCCACCAGGGACTGTCTAGCCCCGTGACCAAGAGCTTCAACCGGGGCGAGTGCTAA |
| F846C.1H12 | 779 | AACATTATGATGACACAGTCGCCATCATCTCTGGCTGTGTCTGCAGGACAAAAGGTCACTATGAGCTGTAAGTCCAGTCAAAGTGTTTTATACAGTTCAAGTCAGAAGAACTACTTGGCCTGGTACCAGCAGAAACCAGGGCAGTCTCCTAAACTTCTGATCTACTGGGCATCCACTAGGGAATCTGGTGTCCCTGATCGCTTCTCAGGCAGTGGATCTGGGACAGATTTTACTCTTACCATCAGCAGTGTACAACCTGAAGACCTGGCAGTTTATTACTGTCATCAATACCTCTCCTCGCTCACGTTCGGTGCTGGGACCAAGCTGGAGCTGAAACGGACCGTGGCCGCCCCAGCGTGTTCATCTTCCCTCCCAGCGACGAGCAGCTGAAGTCTGGCACCGCCAGCGTGGTGTGCCTGCTGAACAACTTCTACCCCGCGAGGCCAAGGTGCAGTGGAAGGTGGACAACGCCCTGCAGAGCGGCAACAGCCAGGAGAGCGTGACCGAGCAGGACTCCAAGGACAGCACCTACAGCCTGAGCAGCACCCTGACCCTGAGCAAGGCCGACTACGAGAAGCACAAGGTGTACGCCTGCGAGGTGACCCACCAGGGACTGTCTAGCCCCGTGACCAAGAGCTTCAACCGGGGCGAGTGCTAA |
| F846C.1H5 | 780 | GATGTTGTGATGACCCAAACTCCACTCTCCCTGCCTGTCAGTCTTGGAGATCAAGCCTCCATCTCTTGCAGATCTAGTCAGAGCCTTGTACACAATAGTGGAAACACCTATTTACATTGGTACCTGCAGAGGCCAGGCCAGTCTCCAAACCTCCTGATCTACAAAGTTTCCAACCGATTTTCTGGGGTCCCAGACAGGTTCAGTGGCAGTGGATCAGGGACAGATTTCACACTCAAGATCAGCAGAGTGGCGGCTGAGGATCTGGGAGTTTATTTCTGCTCTCAAAGTACACATGTTCCTCCGACGTTCGGTGGAGGCACCAAGCTGGAAATCAAACGGACCGTGGCCGCCCCAGCGTGTTCATCTTCCCTCCCAGCGACGAGCAGCTGAAGTCTGGCACCGCCAGCGTGGTGTGCCTGCTGAACAACTTCTACCCCGCGAGGCCAAGGTGCAGTGGAAGGTGGACAACGCCCTGCAGAGCGGCAACAGCCAGGAGAGCGTGACCGAGCAGGACTCCAAGGACAGCACCTACAGCCTGAGCAGCACCCTGACCCTGAGCAAGGCCGACTACGAGAAGCACAAGGTGTACGCCTGCGAGGTGACCCACCAGGGACTGTCTAGCCCCGTGACCAAGAGCTTCAACCGGGGCGAGTGCTAAGGA |
| F846C.2H3 | 781 | AACATTATGATGACACAGTCGCCATCATCTCTGGCTGTGTCTGCAGGAGAAAAGGTCACTATGAGCTGTAAGTCCAGTCAAAGTGTTTTATACAGTTCAAATCAGAAGAACTACTTGGCCTGGTACCAGCAGAAACCAGGGCAGTCTCCTAAACTGCTGATCTACTGGGCATCCACTAGGGAATCTGGTGTCCCTGATCGCTTCACAGGCAGTGGATCTGGGACAGATTTTACTCTTACCATCAGCAGTGTACAACCTGAAGACCTGGCAGTTTATTACTGTCATCAATACCTCTCCTCGCTCACGTTCGGTGCTGGGACCAAGCTGGAGCTGAAACGGACCGTGGCCGCCCCAGCGTGTTCATCTTCCCTCCCAGCGACGAGCAGCTGAAGTCTGGCACCGCCAGCGTGGTGTGCCTGCTGAACAACTTCTACCCCGCGAGGCCAAGGTGCAGTGGAAGGTGGACAACGCCCTGCAGAGCGGCAACAGCCAGGAGAGCGTGACCGAGCAGGACTCCAAGGACAGCACCTACAGCCTGAGCAGCACCCTGACCCTGAGCAAGGCCGACTACGAGAAGCACAAGGTGTACGCCTGCGAGGTGACCCACCAGGGACTGTCTAGCCCCGTGACCAAGAGCTTCAACCGGGGCGAGTGCTAA |

Figure 32 cont.

| Antibody | SEQ ID NO: | LC nucleic acid sequence |
|---|---|---|
| F846TC.14A2 | 782 | CAGGCTGTTGTGACTCAGGAATCTGCACTCACCACATCACCTGGTGAAACAGTCACACTCACTTGTCGCTCAAGTACTGGGGCTGTTACAACTAGTAACTATGCCAACTGGGTCCAAGAAAAACCAGATCATTTATTCACTGGTCTAATAGGTGGTATCAATAACCGAGTTCCAGGTGTTCCTGCCAGATTCTCAGGCTCCCTGATTGGAGACAAGGCAGCCCTCACCATCACAGGGGCACAGACTGAGGATGAGGCAATATATTTCTGTGCTCTATGGTATAGCAACCATTGGGTGTTCGGTGGAGGAACCAAACTGACTGTCCTACGGACCGTGGCCGCCCCAGCGTGTTCATCTTCCCTCCCAGCGACGAGCAGCTGAAGTCTGGCACCGCCAGCGTGGTGTGCCTGCTGAACAACTTCTACCCCGCGAGGCCAAGGTGCAGTGGAAGGTGGACAACGCCCTGCAGAGCGGCAACAGCCAGGAGAGCGTGACCGAGCAGGACTCCAAGGACAGCACCTACAGCCTGAGCAGCACCCTGACCCTGAGCAAGGCCGACTACGAGAAGCACAAGGTGTACGCCTGCGAGGTGACCCACCAGGGACTGTCTAGCCCCGTGACCAAGAGCTTCAACCGGGGCGAGTGCTAA |
| F846TC.14E4 | 783 | GATATTGTGATGACGCAGGCTGCATTCTCCAATCCAGTCACTCTTGGAACATCAGCTTCCATCTCCTGCAGGTCTAGTAAGAGTCTCCTACATACTAATGGCATCACTTTTTTGTATTGGTATCTGCAGAAGCCAGGCCAGTCTCCTCAGCCCCTGATTTATCAGATGTCCAACCTTGCCTCAGGAGTCCCAGACAGGTTCAGTAGCAGTGGGTCAGGAACTGATTTCACACTGAGAATCAGCAGAGTGGAGGCTGAGGATGTGGGTGTTTATTACTGTGCTCAAAATCTAGAACTTCCTTGGACGTTCGGTGGAGGCACCAAGCTGGAAATCAATCGGACCGTGGCCGCCCCAGCGTGTTCATCTTCCCTCCCAGCGACGAGCAGCTGAAGTCTGGCACCGCCAGCGTGGTGTGCCTGCTGAACAACTTCTACCCCGCGAGGCCAAGGTGCAGTGGAAGGTGGACAACGCCCTGCAGAGCGGCAACAGCCAGGAGAGCGTGACCGAGCAGGACTCCAAGGACAGCACCTACAGCCTGAGCAGCACCCTGACCCTGAGCAAGGCCGACTACGAGAAGCACAAGGTGTACGCCTGCGAGGTGACCCACCAGGGACTGTCTAGCCCCGTGACCAAGAGCTTCAACCGGGGCGAGTGCTAA |
| F846TC.16B5 | 784 | AACATTATGATGACACAGTCGCCATCATCTCTGGCTGTGTCTGCAGGAGAAAAGGTCACTATGAGCTGTAAGTCCAGTCAAAGTGTTTTATACAGTTCAAATCAGAAGAACTACTTGGCCTGGTACCAGCAGAAACCAGGGCAGTCTCCTAAACTACTGATCTACTGGGCATCCACTAGGGAATCTGGTGTCCCTGATCGCTTCACAGGCAGTGGATCTGGGACAGATTTTACTCTTACCATCAGCAGTGTACAAGCTGAAGACCTGGCAGTTTATTACTGTCATCAATACCTCTCCTCGCTCACGTTCGGTGCTGGGACCAAGCTGGAGCTGAAACGGACCGTGGCCGCCCCAGCGTGTTCATCTTCCCTCCCAGCGACGAGCAGCTGAAGTCTGGCACCGCCAGCGTGGTGTGCCTGCTGAACAACTTCTACCCCGCGAGGCCAAGGTGCAGTGGAAGGTGGACAACGCCCTGCAGAGCGGCAACAGCCAGGAGAGCGTGACCGAGCAGGACTCCAAGGACAGCACCTACAGCCTGAGCAGCACCCTGACCCTGAGCAAGGCCGACTACGAGAAGCACAAGGTGTACGCCTGCGAGGTGACCCACCAGGGACTGTCTAGCCCCGTGACCAAGAGCTTCAACCGGGGCGAGTGCTAA |
| F846TC.7F10 | 785 | GACATTGTGATGACACAGTCTCCATCCTCCCTGGCTATGTCAGTAGGACAGAAGGTCACTATGAGCTGCAAGTCCAGTCAGAGCCTTTTAAATAGTAGCAATCAAAAGAACTATTTGGCCTGGTACCAGCAGAAACCAGGACAGTCTCCTAAACTTCTGGTATACTTTGCATCCACTAGGGAATCTGGGGTCCCTGATCGCTTCATAGGCAGTGGATCTGGGACAGATTTCACTCTTACCATCAGCAGTGTGCAGGCTGAAGACCTGGCAGATTACTTCTGTCAGCAACATTATAGCACTCCGTACACGTTCGGAGGGGGGCCAAGCTGGAAATAAAACGGACCGTGGCCGCCCCAGCGTGTTCATCTTCCCTCCCAGCGACGAGCAGCTGAAGTCTGGCACCGCCAGCGTGGTGTGCCTGCTGAACAACTTCTACCCCGCGAGGCCAAGGTGCAGTGGAAGGTGGACAACGCCCTGCAGAGCGGCAACAGCCAGGAGAGCGTGACCGAGCAGGACTCCAAGGACAGCACCTACAGCCTGAGCAGCACCCTGACCCTGAGCAAGGCCGACTACGAGAAGCACAAGGTGTACGCCTGCGAGGTGACCCACCAGGGACTGTCTAGCCCCGTGACCAAGAGCTTCAACCGGGGCGAGTGCTAA |

Figure 32 cont.

| Antibody | SEQ ID NO: | LC nucleic acid sequence |
|---|---|---|
| F847C.10B9 | 786 | GACATCCGGATGACTCAGTCTCCATCCAGTCTGTCTGCATCCCTTGGAGACACAAT TACCATCACTTGCCATGCCAGTCAGAACATTAATGTTTGGTTAAGCTGGTACCAGC AGAAACCAGGAAATATTCCTAAACTATTGATCTATAAGGCTTCCAACTTGCACACA GGCGTCCCATCAAGGTTTAGTGGCAGTGGATCTGGAACAGGTTTCACATTAACCAT CAGCAGCCTGCAGCCTGAAGACATTGCCACTTACTACTGTCAACAGGGTCAAAGTT ATCCGTACACGTTCGGAGGGGGGACCAAGCTGGAGCTGAAACGGACCGTGGCCGC CCCCAGCGTGTTCATCTTCCCTCCCAGCGACGAGCAGCTGAAGTCTGGCACCGCCA GCGTGGTGTGCCTGCTGAACAACTTCTACCCCGCGAGGCCAAGGTGCAGTGGAA GGTGGACAACGCCCTGCAGAGCGGCAACAGCCAGGAGAGCGTGACCGAGCAGGA CTCCAAGGACAGCACCTACAGCCTGAGCAGCACCCTGACCCTGAGCAAGGCCGAC TACGAGAAGCACAAGGTGTACGCCTGCGAGGTGACCCACCAGGGACTGTCTAGCC CCGTGACCAAGAGCTTCAACCGGGGCGAGTGCTAA |
| F847C.11B1 | 787 | GAAATTGTGTTGACCCAGTCTCCAGCATCCCTGTCCGTGACTACAGGAGAAAAAGT CACTATCAGATGCATAACCAGCATTGATATTGATGATGATATGAACTGGTACCAGC AGAAGCCAGGGGAACCTCCTAAGCTCCTTATTTCAGAAGGCAATACTCTTCGTCCT GGAGTCCCATCCCGATTCTCCAGCAGTGGCTATGGCACAGATTTTGTTTTTACAATT GAAAACACGCTCTCAGAAGATGTTGCAGATTACTACTGTTTGCAAAGTGATAACAA GCCTCTCACGTTCGGTGCTGGGACCAAGCTGGAGCTGAAACGGACCGTGGCCGCCC CCAGCGTGTTCATCTTCCCTCCCAGCGACGAGCAGCTGAAGTCTGGCACCGCCAGC GTGGTGTGCCTGCTGAACAACTTCTACCCCGCGAGGCCAAGGTGCAGTGGAAGGT GGACAACGCCCTGCAGAGCGGCAACAGCCAGGAGAGCGTGACCGAGCAGGACTCC AAGGACAGCACCTACAGCCTGAGCAGCACCCTGACCCTGAGCAAGGCCGACTACG AGAAGCACAAGGTGTACGCCTGCGAGGTGACCCACCAGGGACTGTCTAGCCCCGT GACCAAGAGCTTCAACCGGGGCGAGTGCTAA |
| F847C.12F12 | 788 | GACATCCAGGTGATTCAGTCTCCATCCAGTCTGTCTGCATCCCTTGGAGACACAAT TACCATCACTTGCCATGCCAGTCAGAACATTAATGTTTGGTTAAGCTGGTACCAGC AGAAACCAGGAAATATTCCTAAACTATTGATCTATAAGGCTTCCAACTTGCACACA GGCGTCCCATCAAGGTTTAGTGGCAGTGGATCTGGAACAGGTTTCACATTAACCAT CAGCAGCCTGCAGCCTGAAGACATTGCCACTTACTACTGTCAACAGGGTCAAAGTT ATCCGTACACGTTCGGAGGGGGGACCAAGCTGGAGCTGAAACGGACCGTGGCCGC CCCCAGCGTGTTCATCTTCCCTCCCAGCGACGAGCAGCTGAAGTCTGGCACCGCCA GCGTGGTGTGCCTGCTGAACAACTTCTACCCCGCGAGGCCAAGGTGCAGTGGAA GGTGGACAACGCCCTGCAGAGCGGCAACAGCCAGGAGAGCGTGACCGAGCAGGA CTCCAAGGACAGCACCTACAGCCTGAGCAGCACCCTGACCCTGAGCAAGGCCGAC TACGAGAAGCACAAGGTGTACGCCTGCGAGGTGACCCACCAGGGACTGTCTAGCC CCGTGACCAAGAGCTTCAACCGGGGCGAGTGCTAA |
| F847C.26F5 | 789 | GAAATTAAGATGAACCAGTCTCCATCCAGTCTGTCTGCATCCCTTGGAGACACAAT TACCATCACTTGCCATGCCAGTCAGAACATTAATGTTTGGTTAAGCTGGTACCAGC AGAAACCAGGAAATATTCCTAAACTATTGATCTATAAGGCTTCCAACTTGCACACA GGCGTCCCATCAAGGTTTAGTGGCAGTGGATCTGGAACAGGTTTCACATTAACCAT CAGCAGCCTACAGCCTGAAGACATTGCCACTTACTACTGTCAACAGGGTCAAAGTT ATCCGTACACGTTCGGAGGGGGGACCAAGCTGGAGCTGAAAGGACCGTGGCCGC CCCCAGCGTGTTCATCTTCCCTCCCAGCGACGAGCAGCTGAAGTCTGGCACCGCCA GCGTGGTGTGCCTGCTGAACAACTTCTACCCCGCGAGGCCAAGGTGCAGTGGAA GGTGGACAACGCCCTGCAGAGCGGCAACAGCCAGGAGAGCGTGACCGAGCAGGA CTCCAAGGACAGCACCTACAGCCTGAGCAGCACCCTGACCCTGAGCAAGGCCGAC TACGAGAAGCACAAGGTGTACGCCTGCGAGGTGACCCACCAGGGACTGTCTAGCC CCGTGACCAAGAGCTTCAACCGGGGCGAGTGCTAAG |

Figure 32 cont.

| Antibody | SEQ ID NO: | LC nucleic acid sequence |
|---|---|---|
| F847C.4B10 | 790 | CAGGCTGTTGTGACTCAGGAATCTGCACTCACCACATCACCTGGTGAAACAGTCAC ACTCACTTGTCGCTCAAGTACTGGGGCTGTTACAACTAGTAACTATGCCAACTGGG TCCAAGAAAAACCAGATCATTTATTCACTGGTCTAATAGGTGGTACCAACAACCGA GCTCCAGGTGTTCCTGCCAGATTCTCAGGCTCCCTGATTGGAGACAAGGCTGCCCT CACCATCACAGGGGCACAGACTGAGGATGAGGCAATATATTTCTGTGCTCTATGGT ACAGCAACCATTTAGTGTTCGGTGGAGGAACCAAACTGACTGTCCTAAGGACCGTG GCCGCCCCCAGCGTGTTCATCTTCCCTCCCAGCGACGAGCAGCTGAAGTCTGGCAC CGCCAGCGTGGTGTGCCTGCTGAACAACTTCTACCCCGCGAGGCCAAGGTGCAGT GGAAGGTGGACAACGCCCTGCAGAGCGGCAACAGCCAGGAGAGCGTGACCGAGC AGGACTCCAAGGACAGCACCTACAGCCTGAGCAGCACCCTGACCCTGAGCAAGGC CGACTACGAGAAGCACAAGGTGTACGCCTGCGAGGTGACCCACCAGGGACTGTCT AGCCCCGTGACCAAGAGCTTCAACCGGGGCGAGTGCTAA |
| F849C.8D10 | 791 | GATGTTTTGATGACCCAAACTCCACTCTCCCTGCCTGTCAGTCTTGGAGATCAAGCC TCCATCTCTTGCAGATCTAGTCAGGACATTGTGCATAGTAGTGGAAACACCTATTT AGAATGGTACCTGCAGAAACCAGGCCAGTCTCTAAAGCTCCTGATTTACAAAGTTT CCAACCGATTTTCTGGGGTCCCAGACAGGTTCAGTGCCAGTGGATCAGGGACAGAT TTCACACTCAAGATCAGCAGAGTGGAGGCTGAGGATCTGGGAGTTTATTACTGCTT TCAAGGTTCACATGTTCCTCCCACGTTCGGCTCGGGGACAAAGTTGGAAATAAAAC GGACCGTGGCCGCCCCCAGCGTGTTCATCTTCCCTCCCAGCGACGAGCAGCTGAAG TCTGGCACCGCCAGCGTGGTGTGCCTGCTGAACAACTTCTACCCCGCGAGGCCAA GGTGCAGTGGAAGGTGGACAACGCCCTGCAGAGCGGCAACAGCCAGGAGAGCGT GACCGAGCAGGACTCCAAGGACAGCACCTACAGCCTGAGCAGCACCCTGACCCTG AGCAAGGCCGACTACGAGAAGCACAAGGTGTACGCCTGCGAGGTGACCCACCAGG GACTGTCTAGCCCCGTGACCAAGAGCTTCAACCGGGGCGAGTGCTAA |
| F849C.8H3 | 792 | GATATTGGGATGAGGCAGGCTGCATTCTCCAATCCAGTCACTCTTGGAACATCAGC TTCCATCTCCTGCAGGTCTAGTAAGAGTCTCCTATATAGTAATGGCATCACTTATTT GTATTGGTTTCTCCAGAAGCCAGGCCAGTCTCCTCAGCTCCTGATTTATCAGATGTC CAACCTTGCCTCAGGAGTCCCAGACAGGTTCAGTAGCAGTGGGTCAGGAACTGATT TCACACTGAGAATCAGCAGAGTGGAGGCTGACGATGTGGGTGTTTATTACTGTGCT CAAAATCTAGAACTTCCGTGGACGTTCGGTGGAGGCACCAAGCTGGAAATCAAAC GGACCGTGGCCGCCCCCAGCGTGTTCATCTTCCCTCCCAGCGACGAGCAGCTGAAG TCTGGCACCGCCAGCGTGGTGTGCCTGCTGAACAACTTCTACCCCGCGAGGCCAA GGTGCAGTGGAAGGTGGACAACGCCCTGCAGAGCGGCAACAGCCAGGAGAGCGT GACCGAGCAGGACTCCAAGGACAGCACCTACAGCCTGAGCAGCACCCTGACCCTG AGCAAGGCCGACTACGAGAAGCACAAGGTGTACGCCTGCGAGGTGACCCACCAGG GACTGTCTAGCCCCGTGACCAAGAGCTTCAACCGGGGCGAGTGCTAA |
| 846.2B11 | 793 | GACATTGTGCTGACACAGTCTCCTGCTTCCTTAGGTGTTTCTCTGGGGCAGAGGGC CACCATCTCATGCAGGGCCAGCAAAAGTGTCAGTACATCTGGCTATAGTTATATGC ACTGGTACCAACAGAAACCAGGACAGCCACCCAAACTCCTCATCTATCTTGCATCC ATCCTAGAATCTGGGGTCCCTGCCAGGTTCAGTGGCAGTGGGTCTGGGACAGACTT CACCCTCAACATCCATCCTGTGGAGGAGGAGGATGCTGCAATCTATTACTGTCAGC ACAGTAGGGAGCTTCCTCTCACGTTCGGTGCTGGGACCAAGCTGGAGCTGAAACG GACCGTGGCCGCCCCCAGCGTGTTCATCTTCCCTCCCAGCGACGAGCAGCTGAAGT CTGGCACCGCCAGCGTGGTGTGCCTGCTGAACAACTTCTACCCCGCGAGGCCAAG GTGCAGTGGAAGGTGGACAACGCCCTGCAGAGCGGCAACAGCCAGGAGAGCGTG ACCGAGCAGGACTCCAAGGACAGCACCTACAGCCTGAGCAGCACCCTGACCCTGA GCAAGGCCGACTACGAGAAGCACAAGGTGTACGCCTGCGAGGTGACCCACCAGGG ACTGTCTAGCCCCGTGACCAAGAGCTTCAACCGGGGCGAGTGCTAA |

Figure 32 cont.

| Antibody | SEQ ID NO: | LC nucleic acid sequence |
|---|---|---|
| 846.4D5 | 794 | AACATTGTGCTGACCCAATCTCCAGCTTCTTTGGCTGTGTCTCTAGGGCAGAGGGCCACCATATCCTGCAGAGCCAGTGAAAGTGTTGATAGTTATGGCAATAGTTTTATGCACTGGTACCAGCAGAAACCAGGACAGCCACCCAAACTCCTCATCTATCTTGCATCCAACCTAGAATCTGGGGTCCCTGCCAGGTTCAGTGGCAGTGGGTCTAGGACAGACTTCACCCTCACCATTGATCCTGTGGAGGCTGATGATGCTGCAACCTATTACTGTCAGCAAAATAATGAGGATCCGTGGACGTTCGGTGGAGGCACCAAGCTGGAAATCAAACGGACCGTGGCCGCCCCCAGCGTGTTCATCTTCCCTCCCAGCGACGAGCAGCTGAAGTCTGGCACCGCCAGCGTGGTGTGCCTGCTGAACAACTTCTACCCCGCGAGGCCAAGGTGCAGTGGAAGGTGGACAACGCCCTGCAGAGCGGCAACAGCCAGGAGAGCGTGACCGAGCAGGACTCCAAGGACAGCACCTACAGCCTGAGCAGCACCCTGACCCTGAGCAAGGCCGACTACGAGAAGCACAAGGTGTACGCCTGCGAGGTGACCCACCAGGGACTGTCTAGCCCCGTGACCAAGAGCTTCAACCGGGGCGAGTGCTAA |
| 846T.1H2 | 795 | GATGTTGTGATGACCCAGACTCCACTCACTTTGTCGGTTACCATTGGACAACCAGCCTCTATCTCTTGCAAGTCAAGTCAGAGTCTCTTATATAGTAATGGAAAAACCTATTTGAATTGGTTATTACAGAGGCCAGGCCAGTCTCCAAAGCGCCTAATCTATCTGGTGTCTAAACTGGACTCTGGAGTCCCTGACAGGTTCACTGGCAGTGGATCAGGAACAGATTTTACACTGAAAATCAGCAGAGTGGAGGCTGAGGATTTGGGAGTTTATTACTGCGTGCAAGGTACACATTTTCCTCAGACGTTCGGTGGAGGCACCAAGCTGGAAATAAAAaGGACCGTGGCCGCCCCCAGCGTGTTCATCTTCCCTCCCAGCGACGAGCAGCTGAAGTCTGGCACCGCCAGCGTGGTGTGCCTGCTGAACAACTTCTACCCCGCGAGGCCAAGGTGCAGTGGAAGGTGGACAACGCCCTGCAGAGCGGCAACAGCCAGGAGAGCGTGACCGAGCAGGACTCCAAGGACAGCACCTACAGCCTGAGCAGCACCCTGACCCTGAGCAAGGCCGACTACGAGAAGCACAAGGTGTACGCCTGCGAGGTGACCCACCAGGGACTGTCTAGCCCCGTGACCAAGAGCTTCAACCGGGGCGAGTGCTAA |
| 847.14H4 | 796 | CAGGCTGTTGTGACTCAGGAATCTGCACTCACCACATCACCTGGTGAAACAGTCACACTCACTTGTCGCTCAAGTACTGGGGCTGTTACAACTAGTAACTATGCCAACTGGGTCCAAGAAAAACCAGATCATTTATTCACTGGTCTAATAGGTGGTACCAACAACCGAGCTCCAGGTGTTCCTGCCAGATTCTCAGGCTCCCTGATTGGAGACAAGGCTGCCCTCACCATCACAGGGGCACAGACTGAGGATGAGGCAATATATTTCTGTGCTCTATGGTACAGCAACCATTTAGTGTTCGGTGGAGGAACCAAACTGACTGTCCTAAGGACCGTGGCCGCCCCCAGCGTGTTCATCTTCCCTCCCAGCGACGAGCAGCTGAAGTCTGGCACCGCCAGCGTGGTGTGCCTGCTGAACAACTTCTACCCCGCGAGGCCAAGGTGCAGTGGAAGGTGGACAACGCCCTGCAGAGCGGCAACAGCCAGGAGAGCGTGACCGAGCAGGACTCCAAGGACAGCACCTACAGCCTGAGCAGCACCCTGACCCTGAGCAAGGCCGACTACGAGAAGCACAAGGTGTACGCCTGCGAGGTGACCCACCAGGGACTGTCTAGCCCCGTGACCAAGAGCTTCAACCGGGGCGAGTGCTAA |
| 2D10.2B2 (murine; mIgG2A (LALAPG)) | 837 | GATATTGTGATGACGCAGGCTGCATTCTCCAATCCAGTCACTCTTGGAACGTCAGCTTCCATCTCCTGCAGGTCTAGTAAGAGTCTCCTACATAGTGATGGCATCACTTATTTGTATTGGTATCTGCAGAGGCCAGGCCAGTCTCCTCAGCTCCTGATATATCGGATGTCCAACCTTGCCTCAGGAGTCCCAGACAGGTTCAGTGGCAGTGGGTCAGGAACTGATTTCACACTGAGAATCAGCAGAGTGGAGGCTGAGGATGTGGGTGTTTATTACTGTGCTCAAATGATAGAATTCCCGCTCACGTTCGGTGCTGGGACCATCCTGGAGCTGAAACGTGCTGATGTTGCCCCTACTGTGTCCATCTTCCCCCCTCCTCCGAGCAGCTGACATCCGGCGGCGCCTCCGTGGTGTGCTTCCTGAACAACTTCTACCCCAAAGACATCAACGTGAAGTGGAAAATCGACGGCTCCGAGAGGCAGAACGGCGTGCTGAACTCCTGGACAGACCAGGACTCCAAAGACTCCACATACTCCATGTCCTCCACACTGACACTGACAAAAGACGAGTACGAGAGGCACAACTCCTACACATGCGAGGCCACACACAAAACATCCACATCCCCCATCGTGAAATCCTTCAACAGGAACGAGTGCTAATAA |

| VL-CDR1 | | VL-CDR2 | | VL-CDR3 | |
|---|---|---|---|---|---|
| SEQ ID NO: | Length | SEQ ID NO: | Length | SEQ ID NO: | Length |

Figure 33B

METHODS OF TREATING INFLAMMATORY DISEASES BY BLOCKING GALECTIN-3

CROSS-REFERENCE TO RELATED APPLICATIONS

This application claims the benefit of priority of U.S. Provisional Patent Application No. 63/030,069, filed May 26, 2020, which is hereby expressly incorporated by reference in its entirety.

REFERENCE TO SEQUENCE LISTING

The present application is being filed along with a Sequence Listing in electronic format. The Sequence Listing is provided as a file entitled SubstituteSeqListingIMMUT020A.TXT, which was created and last modified on Jul. 8, 2024, which is 784,615 bytes in size. The information in the electronic Sequence Listing is hereby incorporated by reference in its entirety.

FIELD OF THE INVENTION

Aspects of the present disclosure relate generally to antibodies or binding fragments thereof that bind Galectin-3 (Gal3). Some aspects bind Gal-3 and block its interaction with viral proteins, such as proteins of the SARS-CoV-2 virus or other coronaviruses, or viral-associated host proteins. Aspects of the present disclosure relate generally to antibodies or binding fragments thereof that reduce inflammation, for example, by reducing activation of immune cells by Gal3.

BACKGROUND

Galectin-3 (Gal3, GAL3) is a lectin, or a carbohydrate-binding protein, with specificity towards beta-galactosides. In human cells, Gal3 is expressed and can be found in the nucleus, cytoplasm, cell surface, and in the extracellular space.

SUMMARY

Galectin-3 (Gal3) has been implicated to have immunomodulatory activity. An example of this is the interaction between Gal3 and T-cell immunoglobulin and mucin-domain containing-3 (TIM-3), which causes suppression of immune responses such as T cell activation and may enable cancer cells to evade immune clearance. This phenomenon and methods to inhibit the same are exemplified in WO 2019/023247 and WO 2020/160156, each of which is hereby expressly incorporated by reference in its entirety.

The COVID-19 pandemic caused by the SARS-CoV-2 coronavirus has resulted in immense impact on human mortality, the global economy, and burden on the public health infrastructure around the world. Much of how the virus interacts with the host immune system is still currently unknown. However, uncontrolled inflammation in response to a SARS-CoV-2 coronavirus can contribute greatly to increased risk of long-term sequelae and death. In addition, coronavirus immunotherapies or vaccines for humans are only beginning to be approved. Therefore, there is a lasting need for new and effective treatments and prophylaxes against SARS-CoV-2 and other coronaviruses, as well as against inflammatory diseases in general.

Disclosed herein are methods, antibodies, and compositions for disrupting an interaction between Galectin-3 (Gal3) and viral proteins, such as proteins of the SARS-CoV-2 virus or other coronaviruses, such as the coronavirus spike protein, or viral-associated host proteins, including ACE2 or CD147.

Also disclosed herein are methods of treating a viral infection. This viral infection may be associated with inflammatory symptoms. In some embodiments, the methods are directed to preventing and/or reducing a viral spread, or reducing a risk that a virus can invade a cell (e.g. either in vitro or in vivo).

Further disclosed herein are methods, medicaments, and compositions involving an anti-Gal3 antibody or binding fragment thereof for the treatment of a disease or a disorder in a subject, such as the treatment of a viral infection, or treatment of a fibrosis, such as lung fibrosis, which may, for example, develop as a sequela of a viral infection, or an inflammatory disease, such as chronic obstructive pulmonary disease (COPD).

Also disclosed herein are the methods and uses of an anti-Gal3 antibodies or binding fragment thereof for the treatment of cytokine release syndrome (CRS, cytokine storm) or sepsis caused, for example, by a bacterial, viral, fungal, or protozoal infection. In some embodiments, the CRS may be a result of the sepsis. In some embodiments, the CRS is a result of a coronavirus infection, such as a SARS-CoV-2 infection.

Also disclosed herein are methods, medicaments, and compositions involving an anti-Gal3 antibody or binding fragment thereof for the treatment of an inflammatory disease, or for decreasing or inhibiting inflammation in a subject. In some embodiments, this inflammation may be associated with activation and/or migration of immune cells such as neutrophils. In some embodiments, administration of the anti-Gal3 antibody or binding fragment thereof decreases or inhibits neutrophil activation and/or migration in the subject. In some embodiments, administration of the anti-Gal3 antibody or binding fragment thereof decreases or inhibits cleavage of CD62L expressed by neutrophils and/or decreases or inhibits IL-8 production in the subject. In some embodiments, administration of the anti-Gal3 antibody or binding fragment thereof decreases the number of neutrophils in the subject. In some embodiments, administration of the anti-Gal3 antibody or binding fragment thereof modulates expression of Gal3, myeloperoxidase (MPO), growth-related oncogene α (GROα)/keratinocytes-derived chemokine (KC), Ly6c1, INOS, IL-6, TNFα, IL-1B, Col1A1, aSMA, TGFβ, VEGFA, VEGFB, or any combination thereof, in the subject. In some embodiments, administration of the anti-Gal3 antibody or binding fragment thereof decreases production of autoantibodies, such as anti-nucleic acid autoantibodies, in the subject. The inflammation may be lung inflammation and associated with diseases including but not limited to COPD, pneumonitis, asthma, sarcoidosis, pulmonary fibrosis, histiocytosis, bronchiolitis obliterans, or any combination thereof. In some embodiments, the inflammation may be associated with an autoimmune disease, including but not limited to systemic lupus erythematosus (SLE), Graves' disease, rheumatoid arthritis, multiple sclerosis, Sjogren's syndrome, celiac disease, or any combination thereof.

Also disclosed herein are methods of decreasing or inhibiting cleavage of CD62L, decreasing IL-8 production, and/or modulating expression of Gal3, MPO, GROα/KC, Ly6c1, INOS, IL-6, TNFα, IL-1B, Col1A1, aSMA, TGFβ, VEGFA, VEGFB, or any combination thereof, by a cell. In some embodiments, the methods comprise contacting the cell with an anti-Gal3 antibody or binding fragment thereof.

Also disclosed herein are pharmaceutical antibody formulations. In some embodiments, the pharmaceutical antibody formulations comprise a therapeutically effective amount of any one or more of the antibodies disclosed herein. In some embodiments, the pharmaceutical antibody formulations further comprise histidine, methionine, NaCl, and polysorbate. In some embodiments, the pharmaceutical antibody formulation is at a pH between 5.3 and 6.3.

Also disclosed herein are sterile vials comprising any one of the pharmaceutical antibody formulations disclosed herein. In some embodiments, the sterile vials comprise a concentrated form of any one of the pharmaceutical antibody formulations disclosed herein, such that the concentrated form is intended to be diluted prior to administration of the pharmaceutical antibody formulation.

The pharmaceutical antibody formulations and sterile vial embodiments disclosed herein may be used in a method of treatment in a subject in need thereof. In some embodiments, the pharmaceutical antibody formulations and sterile vial embodiments disclosed herein are used in a method of treating a coronavirus infection in a subject in need thereof. In some embodiments, the coronavirus infection is a SARS-related coronavirus infection. In some embodiments, the coronavirus infection is a SARS-CoV-2 infection. In some embodiments, the pharmaceutical antibody formulations and sterile vial embodiments disclosed herein are used in a method of decreasing or inhibiting inflammation in a subject in need thereof. In some embodiments, the inflammation may be associated with an inflammatory disease, including but not limited to lung inflammation, such as COPD, pneumonitis, asthma, sarcoidosis, pulmonary fibrosis, histiocytosis, bronchiolitis obliterans, or any combination thereof, or an autoimmune disease, such as systemic lupus erythematosus (SLE), Graves' disease, rheumatoid arthritis, multiple sclerosis, Sjogren's syndrome, celiac disease, or any combination thereof.

BRIEF DESCRIPTION OF THE DRAWINGS

In addition to the features described above, additional features and variations will be readily apparent from the following descriptions of the drawings and exemplary embodiments. It is to be understood that these drawings depict typical embodiments and are not intended to be limiting in scope.

FIG. 6 depicts various embodiments of sequences of human Gal3 (isoform 1 and 3), ACE2, CD147, and SARS-CoV-2 S protein.

FIG. 7 depicts Gal3 peptides used for generating anti-Gal3 antibodies and binning.

FIG. 8 depicts variable heavy chain CDR1 sequences of exemplary anti-Gal3 antibodies. In some embodiments, any of the method or compositions provided herein can include one or more of the CDRs provided herein.

FIG. 9 depicts variable heavy chain CDR2 sequences of exemplary anti-Gal3 antibodies. In some embodiments, any of the method or compositions provided herein can include one or more of the CDRs provided herein.

FIG. 10 depicts variable heavy chain CDR3 sequences of exemplary anti-Gal3 antibodies. In some embodiments, any of the method or compositions provided herein can include one or more of the CDRs provided herein.

FIG. 11 depicts variable light chain CDR1 sequences of exemplary anti-Gal3 antibodies. In some embodiments, any of the method or compositions provided herein can include one or more of the CDRs provided herein.

FIG. 12 depicts variable light chain CDR2 sequences of exemplary anti-Gal3 antibodies. In some embodiments, any of the method or compositions provided herein can include one or more of the CDRs provided herein.

FIG. 13 depicts variable light chain CDR3 sequences of exemplary anti-Gal3 antibodies. In some embodiments, any of the method or compositions provided herein can include one or more of the CDRs provided herein.

FIG. 14 depicts heavy and light chain CDR combinations of various exemplary anti-Gal3 antibodies. In some embodiments, any of the method or compositions provided herein can include one or more of the heavy and light chain CDR combinations provided herein.

FIG. 15 depicts heavy chain variable region sequences of exemplary anti-Gal3 antibodies. In some embodiments, any of the methods or compositions provided herein can include any one of these VH regions.

FIG. 16 depicts light chain variable region sequences of exemplary anti-Gal3 antibodies. In some embodiments, any of the methods or compositions provided herein can include any one of these VL regions.

FIG. 17 depicts heavy chain variable region and light chain variable region sequences of exemplary anti-Gal3 antibodies. In some embodiments, any one or more of the VH/VL and/or CDRs provided in the other figures can be paired with any one or more of the relevant sequences provided herein.

FIG. 18 depicts heavy chain and light chain sequences of exemplary anti-Gal3 antibodies. In some embodiments, any one or more of the VH/VL and/or CDRs provided in the other figures can be paired with any one or more of the relevant sequences provided herein.

FIG. 20 depicts antibody affinities ($K_D$) of anti-Gal3 humanized antibodies IMT001 and IMT006a for human, cynomolgus, and mouse Gal3.

FIG. 24A depicts elevated expression of Gal3 in bronchoalveolar fluid samples of a chronic obstructive pulmonary disease (COPD) mouse model. FIG. 24B depicts elevated transcript levels of Gal3 and genes associated with neutrophil number and function (Ly6c1, Kc, Inos), inflammatory cytokines (Il6, Tnfa, Il1b), and fibrosis (Col1A1, aSma, Tgfb, Vegfa, Vegfb) in lung tissue from a COPD mouse model compared to healthy tissue. Treatment with the exemplary anti-Gal3 antibodies 2D10.2B2 and mTB001 resulted in a reduction of these transcript levels in the COPD model. FIG. 24C depicts increases in % and total neutrophil count in lung tissue of a COPD model compared to healthy tissue, and treatment with the exemplary anti-Gal3 antibodies results in a reduction in the neutrophil count. FIG. 24D depicts an increased expression of myeloperoxidase (MPO) and keratinocytes-derived chemokine (KC) in bronchoalveolar fluid samples of a COPD mouse model compared to healthy mice. Treatment with 2D10.2B2 and mTB001 reduced expression of MPO, and 2D10.2B2 also had a significant effect on reducing expression of KC in the diseased model.

FIG. 28 depicts antibody names used throughout the present disclosure refer to the same antibody (with exemplary peptide and nucleic acid sequences provided elsewhere in the disclosure and appropriately attributed to at least one of the depicted names) and may be used interchangeably. The names shown in a column correspond to the same antibody.

FIG. 29 depicts nucleic acid sequences that encode for exemplary heavy chain variable regions of anti-Gal3 antibodies disclosed herein. In some embodiments, any of the compositions or methods provided herein can include one or more of the heavy chain variable regions encoded by the nucleic acids provided herein.

FIG. 30 depicts nucleic acid sequences that encode for exemplary light chain variable regions of anti-Gal3 antibodies disclosed herein. In some embodiments, any of the compositions or methods provided herein can include one or more of the light chain variable regions encoded by the nucleic acids provided herein.

FIG. 31 depicts nucleic acid sequences that encode for exemplary heavy chains of anti-Gal3 antibodies disclosed herein. In some embodiments, any of the compositions or methods provided herein can include one or more of the heavy chains encoded by the nucleic acids provided herein.

FIG. 32 depicts nucleic acid sequences that encode for exemplary light chains of anti-Gal3 antibodies disclosed herein. In some embodiments, any of the compositions or methods provided herein can include one or more of the light chains encoded by the nucleic acids provided herein.

FIG. 33A-B depicts an exemplary alignment for the heavy chain CDRs (FIG. 33A) and light chain CDRs (FIG. 33B) for the exemplary anti-Gal3 antibodies disclosed herein.

DETAILED DESCRIPTION

Figure 1:
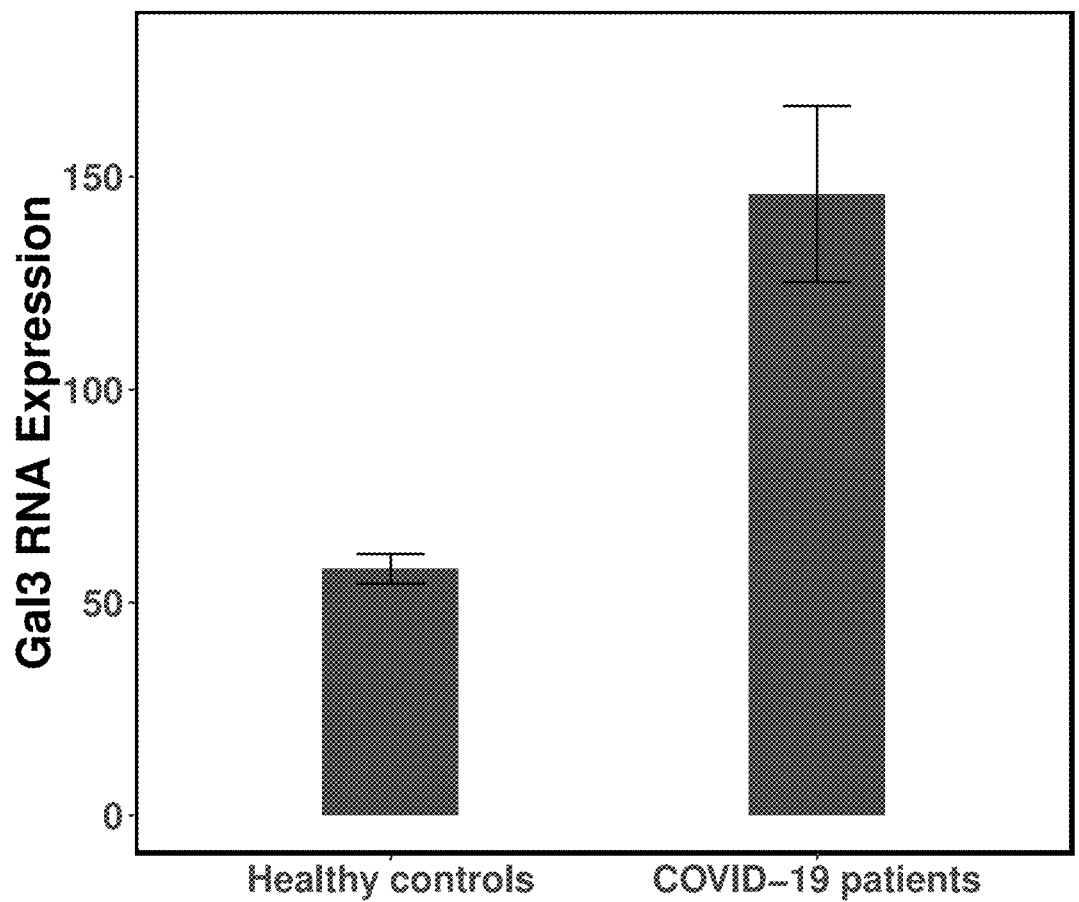
FIG. 1 depicts a graphical representation of relative Gal3 mRNA expression in normal individuals and COVID-19 patients.

Galectin-3 (Gal3, GAL3) is known to play an important role in cell proliferation, adhesion, differentiation, angiogenesis, and apoptosis. This activity is, at least in part, due to immunomodulatory properties and binding affinity towards other immune regulatory proteins, signaling proteins, and other cell surface markers. Gal3 functions by distinct N-terminal and C-terminal domains. The N-terminal domain (isoform 1: amino acids 1-111, isoform 3: amino acids 1-125) comprise a tandem repeat domain (TRD, isoform 1: amino acids 36-109, isoform 3: amino acids 50-123) and is largely responsible for oligomerization of Gal3. The C-terminal domain (isoform 1: amino acids 112-250, isoform 3: amino acids 126-264) comprise a carbohydrate-recognition-binding domain (CRD), which binds to β-galactosides. An exemplary sequence for isoform 1 of human Gal3 (NCBI Reference No. NP_002297.2) is shown in SEQ ID NO: 1. An exemplary sequence for isoform 3 of human Gal3 (NCBI Reference No. NP_001344607.1) is shown in SEQ ID NO: 2.

Furthermore, Gal3 plays an important role in promoting leukocyte recruitment to sites infected by a pathogen, such as a virus. Increased cytokine release by leukocytes that fight a viral infection may trigger a cytokine release syndrome (CRS, "cytokine storm"). CRS is a major cause of lethal outcome for patients infected with SARS-CoV-2 and other coronaviruses. Inhibition of Gal3 activity hinders leukocyte recruitment and reduces levels of harmful cytokine production.

In some embodiments, anti-Gal3 antibodies or binding fragments thereof or compositions comprising anti-Gal3 antibodies or binding fragments thereof are provided. In some embodiments, the anti-Gal3 antibodies or binding fragments thereof bind to the N-terminal domain, the N-terminus and/or the TRD of Gal3. In some embodiments, the anti-Gal3 antibodies or binding fragments thereof bind to the C-terminal domain, the C-terminus and/or the CRD of Gal3. In some embodiments, the anti-Gal3 antibodies or binding fragments thereof do not bind to the N-terminal domain, the N-terminus and/or the TRD of Gal3. In some embodiments, the anti-Gal3 antibodies or binding fragments thereof do not bind to the C-terminal domain, the C-terminus and/or the CRD of Gal3.

Some embodiments disclosed herein are antibodies and binding fragments thereof that are specific for Galectin-3 (Gal3), and methods of use thereof for the treatment or prevention of a viral infection, such as a SARS-CoV-2 infection, a SARS-related coronavirus infection, or other coronavirus infection. The anti-Gal3 antibodies and binding fragments thereof disclosed herein disrupt the interaction between Gal3 and the SARS-CoV-2 spike (S) protein. The anti-Gal3 antibodies and binding fragments thereof disclosed herein also disrupt the interaction between Gal3 and host cell receptors that viruses use to enter a host cell, such as ACE2 and/or CD147. Also disclosed herein are methods of using the anti-Gal3 antibodies and binding fragments thereof for the treatment of sequela of a viral infection, such as pulmonary fibrosis caused as a result of a respiratory viral infection such as a SARS-CoV-2 infection, as well as decreasing or inhibiting toxicity due to cytokine release syndrome (CRS) that may occur, for example, due to a respiratory viral infection such as a SARS-CoV-2 infection.

Provided herein are embodiments that related to anti-Gal3 antibodies or binding fragments thereof and their use in methods and uses to disrupt the interaction between Gal3 and viral proteins or host receptor proteins. In some embodiments, this disruption is used to treat an on-going viral infection. In some embodiments, the viral infection is a coronavirus infection. In some embodiments, the viral infection is a SARS-CoV-2 viral infection. In other embodiments, this disruption is used to treat a sequela of a prior viral infection.

In some embodiments, the methods involve an antibody that binds to Gal3 and disrupts an interaction between Gal3 and another protein, such as a viral protein or a host receptor protein. This can be a direct obstruction of the interaction zone between Gal3 and the other protein, or an indirect alteration, such as a binding that results in a conformational change of Gal3, so that it no longer binds or is active with the other protein. It can also result by binding to a first section of Gal3, where some other part of the antibody obstructs or alters the interaction between Gal3 and the other protein. In some embodiments, the first section of Gal3 is the N-terminal domain of Gal3, the tandem repeat domain (TRD) of Gal3, or the C-terminal domain of Gal3. In some embodiments, the antibody that binds to Gal3 does not bind to the C-terminal domain of Gal3.

In some embodiments, a method is provided of disrupting an interaction between Gal3 and a viral protein or a host receptor protein. In some embodiments, the method comprises contacting an interaction site between Gal3 and the viral protein or host receptor protein with an antibody or binding fragment thereof that selectively binds to Gal3 and disrupts the interaction between Gal3 and the viral protein or host receptor protein.

In some embodiments, methods of using the anti-Gal3 antibodies or binding fragments thereof or compositions comprising anti-Gal3 antibodies or binding fragments thereof to block or disrupt an interaction between Gal3 and another protein either in vitro or in vivo are provided. In some embodiments, the interaction is between Gal3 and a viral protein. In some embodiments, the viral protein is a coronavirus protein. In some embodiments, the viral protein is a SARS-CoV-2 protein. In some embodiments, the viral protein is a SARS-CoV-2 S, E, M, or HE protein. In some embodiments, the viral protein is a SARS-CoV-2 S protein. In some embodiments, the interaction is between Gal3 and a host receptor protein that a virus uses to enter the host cell. In some embodiments, the host receptor protein is a protein used by a coronavirus to enter the host cell. In some embodiments, the host receptor protein is a protein used by a SARS-CoV-2 virus to enter the host cell. In some embodiments, the host receptor protein is ACE2 and/or CD147. In some embodiments, the methods of using the anti-Gal3 antibodies or binding fragments thereof or compositions comprising anti-Gal3 antibodies or binding fragments thereof to block or disrupt an interaction between Gal3 and another protein is used to treat, cure, or prevent a disease or disorder in a subject. In some embodiments, the disease or disorder is a viral infection, such as a SARS-CoV-2 infection or other coronavirus infection. In some embodiments, the disease or disorder is a sequela of a prior viral (e.g. SARS-CoV-2 or other coronavirus) infection. In some embodiments, the sequela comprises fibrosis such as lung fibrosis. In some embodiments, the anti-Gal3 antibodies or binding fragments thereof are administered in conjunction with another antiviral or anti-inflammatory therapy. In some embodiments, the disease or disorder is CRS. In some embodiments, the CRS is a result of a viral infection. In some embodiments, the CRS is a result of a SARS-CoV-2 infection or other coronavirus infection. In some embodiments, the disease or disorder is sepsis. In some embodiments, the disease or disorder is viral sepsis. In some embodiments, the CRS is a result of sepsis caused by a viral infection. In some embodiments, the CRS is a result of sepsis caused by a SARS-CoV-2 infection or other coronavirus infection.

Also disclosed herein are methods of decreasing or inhibiting inflammation in a subject in need thereof. In some embodiments, the methods comprise administering to the subject an effective amount of an anti-Gal3 antibody or binding fragment thereof. The inflammation may or may not be associated with a viral infection, such as a coronavirus infection. In some embodiments, inflammation may be associated with a disease, such as an inflammatory disease or an autoimmune disease. For example, the inflammatory disease may comprise lung inflammation, COPD, pneumonitis, asthma, sarcoidosis, pulmonary fibrosis, histiocytosis, bronchiolitis obliterans, or any combination thereof, or an autoimmune disease such as systemic lupus erythematosus, Graves' disease, rheumatoid arthritis, multiple sclerosis, Sjogren's syndrome, celiac disease, or any combination thereof. The inflammation may be associated with neutrophil activation and/or migration, where administration of the anti-Gal3 antibody or binding fragment thereof reduces or inhibits neutrophil activation and/or migration.

Additional aspects of the present disclosure relate generally to pharmaceutical antibody formulations comprising antibodies that bind to Gal3 and one or more excipients, diluents, carriers, salts, buffers, and the like. These pharmaceutical antibody formulations are used to treat a disease such as an infection by a pathogen such as a virus, and/or inflammation associated with the aforementioned or herein disclosed disease(s). In some embodiments, the pharmaceutical antibody formulations comprise any one of the anti-Gal3 antibodies disclosed herein, histidine, methionine, NaCl, and polysorbate, and is at a pH of between 5.3 and 6.3. Also disclosed herein are sterile vials comprising any one of the pharmaceutical antibody formulations disclosed herein, including concentrated forms of the pharmaceutical antibody formulations intended to be diluted for administration.

Also disclosed herein are embodiments of methods of treating a coronavirus infection, comprising administering any one of the pharmaceutical antibody formulations disclosed herein to a subject in need of treatment for a coronavirus infection. In some embodiments, the subject is a mammal. In some embodiments, the subject is a human.

Definitions

In the following detailed description, reference is made to the accompanying drawings, which form a part hereof. In the drawings, similar symbols typically identify similar components, unless context dictates otherwise. The illustrative embodiments described in the detailed description, drawings, and claims are not meant to be limiting. Other embodiments may be utilized, and other changes may be made, without departing from the spirit or scope of the subject matter presented herein. It will be readily understood that the aspects of the present disclosure, as generally described herein, and illustrated in the Figures, can be arranged, substituted, combined, separated, and designed in a wide variety of different configurations, all of which are explicitly contemplated herein.

Unless defined otherwise, technical and scientific terms used herein have the same meaning as commonly understood by one of ordinary skill in the art to which the present disclosure belongs. For purposes of the present disclosure, the following terms are defined below.

The articles "a" and "an" are used herein to refer to one or to more than one (for example, at least one) of the grammatical object of the article. By way of example, "an element" means one element or more than one element.

By "about" is meant a quantity, level, value, number, frequency, percentage, dimension, size, amount, weight or length that varies by as much as 30, 25, 20, 15, 10, 9, 8, 7, 6, 5, 4, 3, 2 or 1% to a reference quantity, level, value, number, frequency, percentage, dimension, size, amount, weight or length.

Throughout this specification, unless the context requires otherwise, the words "comprise," "comprises," and "comprising" will be understood to imply the inclusion of a stated step or element or group of steps or elements but not the exclusion of any other step or element or group of steps or elements. By "consisting of" is meant including, and limited to, whatever follows the phrase "consisting of" Thus, the phrase "consisting of" indicates that the listed elements are required or mandatory, and that no other elements may be present. By "consisting essentially of" is meant including any elements listed after the phrase and limited to other elements that do not interfere with or contribute to the activity or action specified in the disclosure for the listed elements. Thus, the phrase "consisting essentially of" indicates that the listed elements are required or mandatory, but that other elements are optional and may or may not be present depending upon whether or not they materially affect the activity or action of the listed elements.

The term "coronavirus" as used herein refers to the family of enveloped, positive-sense, single stranded RNA viruses that infect mammals and birds. In humans, coronavirus infections can cause mild symptoms as a common cold, or more severe respiratory conditions such as severe acute respiratory syndrome (SARS), acute respiratory distress syndrome (ARDS), coughing, congestion, sore throat, shortness of breath, pneumonia, bronchitis, and hypoxia. Other symptoms include but are not limited to fever, fatigue, myalgia, and gastrointestinal symptoms such as vomiting, diarrhea, and abdominal pain. The viral envelope comprises spike ("S"), envelope ("E"), membrane ("M"), and hemagglutinin esterase ("HE") transmembrane structural proteins. The S protein comprises a receptor binding domain ("RBD"), a highly immunogenic region that determines the host receptor specificity of the virus strain. The viral nucleocapsid comprises multiple nucleocapsid ("N" or "NP") proteins coating the RNA genome. During infection, the S protein attaches to a host cell receptor and initiate entry into the host cell through endocytosis or fusion of the envelope membrane. The RNA genome is translated by the host ribosome to produce new structural proteins and RNA-dependent RNA polymerases, which replicate the viral genome. Viral particles are assembled in the host endoplasmic reticulum and are shed by Golgi-mediated exocytosis. More information about the structure and infection cycle of coronaviruses can be found in Fehr AR & Perlman S. "Coronaviruses: An Overview of Their Replication and Pathogenesis" *Methods Mol. Biol.* (2015); 1282:1-23, hereby expressly incorporated by reference in its entirety.

The terms "SARS-CoV-2" and "2019-nCoV" as used herein refers to the coronavirus strain responsible for the human coronavirus disease 2019 ("COVID-19") pandemic. The contagiousness, long incubation period, and modern globalization has led to worldwide spread of the virus. Development of SARS and other respiratory issues in infected individuals has resulted in immense stress on medical infrastructure. While testing is ongoing, there are currently no approved treatments or vaccines for SARS-CoV-2 and other coronaviruses in humans. Like the original SARS virus (SARS-CoV-1), SARS-CoV-2 infects human cells by binding to angiotensin-converting enzyme 2 (ACE2) through the RBD of the S protein. The SARS-CoV-2 virus may also enter host cells using the CD147 (basigin, EMMPRIN) host cell receptor. The embodiments disclosed herein can be applied to other coronaviruses, including but not limited to HCoV-229E, HCoV-OC43, SARS-CoV-1, HCoV NL63, HKU1, and MERS-CoV. An exemplary sequence for the SARS-CoV-2 spike (S) protein (NBCI Reference No. QHD43416.1) is shown in SEQ ID NO: 819. An exemplary sequence for human angiotensin-converting enzyme 2 (ACE2) is shown in SEQ ID NO: 820. An exemplary sequence for human CD147 (basigin, EMMPRIN) (NCBI Reference No. Q54A51) is shown in SEQ ID NO: 821.

The terms "sequela" or "sequelae" as used herein refer to the diseases, disorders, or conditions that develop as a result of a previous disease, disorder, or condition. As coronaviruses such as SARS-CoV-2 are respiratory viruses, complications involving the lungs are common sequelae of a coronavirus infection. This includes pulmonary fibrosis and/or pulmonary edema. Other sequelae observed in patients afflicted with COVID-19 include but are not limited to other fibroses, cardiovascular disease, thrombosis, neurological disease, kidney disease, or liver disease.

The terms "cytokine release syndrome" (CRS) or "cytokine storm" as used herein refer to an uncontrolled release of proinflammatory cytokines by immune cells, including T cells, natural killer cells, macrophages, dendritic cells, B cells, monocytes, neutrophils, leukocytes, lymphocytes, in response to a disease, infection, or immunotherapy. CRS is caused by an infectious stimuli, non-infectious stimuli, condition, or syndrome, or any combination thereof. Diseases or infections that can cause CRS include but are not limited to bacterial infections, viral infections, fungal infections, protozoan infections, graft-versus-host disease, cytomegalovirus, Epstein-Barr virus, hemophagocytic lymphohistiocystosis (HLH), Epstein-Barr virus-associated HLH, sporadic HLH, macrophage activation syndrome (MAS), chronic arthritis, systemic Juvenile idiopathic Arthritis (sJIA), Still's Disease, Cryopyrin-associated Periodic Syndrome (CAPS), Familial Cold Auto-inflammatory Syndrome (FCAS), Familial Cold Urticaria (FCU), Muckle-Well Syndrome (MWS), Chronic Infantile Neurological Cutaneous and Articular (CINCA) Syndrome, cryopyrinopathy comprising inherited or de novo gain of function mutations in the NLRP3 gene, a hereditary auto-inflammatory disorder, acute pancreatitis, severe burns, trauma, acute respiratory distress syndrome (ARDS), *Streptococcus, Pseudomonas*, influenza, bird flu, H5N1, H1N1, variola virus, coronavirus, severe acute respiratory syndrome (SARS), SARS-CoV-1, SARS-CoV-2, sepsis, gram-negative sepsis, Gram-positive toxins, malaria, Ebola virus, variola virus, systemic Gram-negative bacterial infection, bacteremia, Jarisch-Herxheimer syndrome, glycosylphosphatidylinositol (GPI), or lipopolysaccharide. Immunotherapies that can cause CRS include but are not limited to rituximab, obinutuzumab, alemtuzumab, brentuximab, dacetuzumab, nivolumab, theralizumab, oxaliplatin, lenalidomide, T-cell engager molecules, bi-specific T-cell engager (BiTE) molecules, or CAR T therapy. CRS can be treated using anti-inflammatory therapies, including but not limited to anti-cytokine antibodies, angiotensin-converting enzyme inhibitors, angiotensin II receptor blockers, corticosteroids, free radical scavengers, or TNF-$\alpha$ blockers.

As used herein, the term "cytokine" refers to small proteins, polypeptides, or peptides that are involved in inflammatory signaling or proteins released by one cell population that act on another cell as intercellular mediators or have an autocrine effect on the cells producing the proteins. Cytokines include but are not limited to chemokines, interferons, interleukins, lymphokines, monokines, tumor necrosis factors, CCL1, CCl2, CCL3, CCL4, CCL5, CCL6, CCL7, CCL8, CCL9, CCL11, CCL12, CCL13, CCL14, CCL15, CCL16, CCL17, CCL18, CCL19, CCL20, CCL21, CCL22, CCL23, CCL24, CCL25, CCL26, CCL27, CCL28, CXCL1, CXCL2, CXCL3, CXCL4, CXCL5, CXCL6, CXCL7, CXCL8, CXCL9, CXCL10, CXCL11, CXCL12, CXCL13, CXCL14, CXCL15, CXCL16, CXCL17, CX3CL1, XCL1, XCL2, INF$\alpha$, INF$\beta$, INF$\gamma$, IL-1, IL-1a, IL-2, IL-3, IL-4, IL-5, IL-6, IL-7, IL-8, IL-9, IL-10, IL-11, IL-12, IL-13, IL-14, IL-15, IL-16, IL-17, IL-17A-F, IL-18, IL-19, IL-20, IL-21, IL-22, IL-23, IL-24, IL-25, IL-26, IL-27, IL-28, IL-29, IL-30, IL-31, IL-32, IL-33, IL-34, IL-35, IL-36, IL-37, IL-38, adesleukin, GM-CSF, TNF$\alpha$, TNF$\beta$, TNF$\gamma$, TGF-I-3 TNFSF4, TNFSF5, TNFSF6, TNFSF7, TNFSF8, TNFSF9, TNFSF10, TNFSF11, TNFSF12, TNFSF13, TNFSF13B, TNFSF14, TNFSF15, TNFSF18, or TNFSF19, leukemia inhibitor factor (LIF), ciliary neurotrophic factor (CNTF), CNTF-like cytokine (CLC), cardiotrophin (CT), Kit ligand (KL), or any combination thereof.

As used herein, the terms "individual(s)", "subject(s)" and "patient(s)" mean any mammal. In some embodiments, the mammal is a human. In some embodiments, the mammal is a non-human. None of the terms require or are limited to situations characterized by the supervision (e.g. constant or intermittent) of a health care worker (e.g. a doctor, a registered nurse, a nurse practitioner, a physician's assistant, an orderly or a hospice worker).

As used herein, the terms "polypeptide", "peptide", and "protein" are used interchangeably herein to refer to polymers of amino acids of any length. The polymer may be linear, cyclic, or branched, it may comprise modified amino acids, and it may be interrupted by non-amino acids. The terms also encompass amino acid polymers that have been modified, for example, via sulfation, glycosylation, lipidation, acetylation, phosphorylation, iodination, methylation, oxidation, proteolytic processing, phosphorylation, prenylation, racemization, selenoylation, transfer-RNA mediated addition of amino acids to proteins such as arginylation, ubiquitination, or any other manipulation, such as conjugation with a labeling component.

As used herein, the term "amino acid" refers to either natural and/or unnatural or synthetic amino acids, including glycine and both the D or L optical isomers, and amino acid analogs and peptidomimetics.

A polypeptide or amino acid sequence "derived from" a designated protein refers to the origin of the polypeptide. Preferably, the polypeptide has an amino acid sequence that is essentially identical to that of a polypeptide encoded in the sequence, or a portion thereof wherein the portion consists of at least 10-20 amino acids, or at least 20-30 amino acids, or at least 30-50 amino acids, or which is immunologically identifiable with a polypeptide encoded in the sequence. This terminology also includes a polypeptide expressed from a designated nucleic acid sequence.

As used herein, the term "antibody" is intended to include any polypeptide chain-containing molecular structure with a specific shape that fits to and recognizes an epitope, where one or more non-covalent binding interactions stabilize the complex between the molecular structure and the epitope. Antibodies utilized in the present invention may be polyclonal antibodies, although monoclonal antibodies are preferred because they may be reproduced by cell culture or recombinantly and can be modified to reduce their antigenicity.

In addition to entire immunoglobulins (or their recombinant counterparts), immunoglobulin fragments or "binding fragments" comprising the epitope binding site (e.g., Fab', F(ab')$_2$, single-chain variable fragment (scFv), diabody, minibody, nanobody, single-domain antibody (sdAb), or other fragments) are useful as antibody moieties in the present invention. Such antibody fragments may be generated from whole immunoglobulins by ricin, pepsin, papain, or other protease cleavage. Minimal immunoglobulins may be designed utilizing recombinant immunoglobulin techniques. For instance "Fv" immunoglobulins for use in the present invention may be produced by linking a variable light chain region to a variable heavy chain region via a peptide linker (e.g., poly-glycine or another sequence which does not form an alpha helix or beta sheet motif). Nanobodies or single-domain antibodies can also be derived from alternative organisms, such as dromedaries, camels, llamas, alpacas, or sharks. In some embodiments, antibodies can be conjugates, e.g. pegylated antibodies, drug, radioisotope, or toxin conjugates. Monoclonal antibodies directed against a specific epitope, or combination of epitopes, will allow for the targeting and/or depletion of cellular populations expressing the marker. Various techniques can be utilized using monoclonal antibodies to screen for cellular populations expressing the marker(s), and include magnetic separation using antibody-coated magnetic beads, "panning" with antibody attached to a solid matrix (i.e., plate), and flow cytometry (e.g. U.S. Pat. No. 5,985,660, hereby expressly incorporated by reference in its entirety).

As known in the art, the term "Fc region" is used to define a C-terminal region of an immunoglobulin heavy chain. The "Fc region" may be a native sequence Fc region or a variant Fc region. Although the boundaries of the Fc region of an immunoglobulin heavy chain might vary, the human IgG heavy chain Fc region is usually defined to stretch from an amino acid residue at position Cys226, or from Pro230, to the carboxyl-terminus thereof. The numbering of the residues in the Fc region is that of the EU index as in Kabat. Kabat et al., Sequences of Proteins of Immunological Interest, 5th Ed. Public Health Service, National Institutes of Health, Bethesda, Md., 1991. The Fc region of an immunoglobulin generally comprises two constant domains, CH2 and CH3. As is known in the art, an Fc region can be present in dimer or monomeric form.

As known in the art, a "constant region" of an antibody refers to the constant region of the antibody light chain or the constant region of the antibody heavy chain, either alone or in combination.

A "variable region" of an antibody refers to the variable region of the antibody light chain or the variable region of the antibody heavy chain, either alone or in combination. As known in the art, the variable regions of the heavy and light chains each consist of four framework regions (FRs) connected by three complementarity determining regions (CDRs) also known as hypervariable regions, and contribute to the formation of the antigen binding site of antibodies. If variants of a subject variable region are desired, particularly with substitution in amino acid residues outside of a CDR region (i.e., in the framework region), appropriate amino acid substitution, preferably, conservative amino acid substitution, can be identified by comparing the subject variable region to the variable regions of other antibodies which contain CDR1 and CDR2 sequences in the same canonical class as the subject variable region (Chothia and Lesk, J Mol Biol 196(4): 901-917, 1987).

In certain embodiments, definitive delineation of a CDR and identification of residues comprising the binding site of an antibody is accomplished by solving the structure of the antibody and/or solving the structure of the antibody-ligand complex. In certain embodiments, that can be accomplished by any of a variety of techniques known to those skilled in the art, such as X-ray crystallography. In certain embodiments, various methods of analysis can be employed to identify or approximate the CDR regions. In certain embodiments, various methods of analysis can be employed to identify or approximate the CDR regions. Examples of such methods include, but are not limited to, the Kabat definition, the Chothia definition, the IMGT approach (Lefranc et al., 2003) Dev Comp Immunol. 27:55-77), computational programs such as Paratome (Kunik et al., 2012, Nucl Acids Res. W521-4), the AbM definition, and the conformational definition.

The Kabat definition is a standard for numbering the residues in an antibody and is typically used to identify CDR regions. See, e.g., Johnson & Wu, 2000, Nucleic Acids Res., 28: 214-8. The Chothia definition is similar to the Kabat definition, but the Chothia definition takes into account positions of certain structural loop regions. See, e.g., Chothia et al., 1986, J. Mol. Biol., 196: 901-17; Chothia et al., 1989, Nature, 342: 877-83. The AbM definition uses an integrated suite of computer programs produced by Oxford Molecular Group that model antibody structure. See, e.g., Martin et al., 1989, Proc Natl Acad Sci (USA), 86:9268-9272; "AbM™, A Computer Program for Modeling Variable Regions of Antibodies," Oxford, UK; Oxford Molecular, Ltd. The AbM definition models the tertiary structure of an antibody from primary sequence using a combination of knowledge databases and ab initio methods, such as those described by Samudrala et al., 1999, "Ab Initio Protein Structure Prediction Using a Combined Hierarchical Approach," in PROTEINS, Structure, Function and Genetics Suppl., 3:194-198. The contact definition is based on an analysis of the available complex crystal structures. See, e.g., MacCallum et al., 1996, J. Mol. Biol., 5:732-45. In another approach, referred to herein as the "conformational definition" of CDRs, the positions of the CDRs may be identified as the residues that make enthalpic contributions to antigen binding. See, e.g., Makabe et al., 2008, Journal of Biological Chemistry, 283:1156-1166. Still other CDR boundary definitions may not strictly follow one of the above approaches, but will nonetheless overlap with at least a portion of the Kabat CDRs, although they may be shortened or lengthened in light of prediction or experimental findings that particular residues or groups of residues do not significantly impact antigen binding. As used herein, a CDR may refer to CDRs defined by any approach known in the art, including combinations of approaches. The methods used herein may utilize CDRs defined according to any of these approaches. For any given embodiment containing more than one CDR, the CDRs may be defined in accordance with any of Kabat, Chothia, extended, IMGT, Paratome, AbM, and/or conformational definitions, or a combination of any of the foregoing.

As disclosed herein, sequences having a % identity to any of the sequences disclosed herein are envisioned and may be used. The terms "% identity" refer to the percentage of units (i.e. amino acids or nucleotides) that are the same between two or more sequences relative to the length of the sequence. When the two or more sequences being compared are the same length, the % identity will be respective that length. When two or more sequences being compared are different lengths, deletions and/or insertions may be introduced to obtain the best alignment. In some embodiments, these sequences may include peptide sequences, nucleic acid sequences, CDR sequences, variable region sequences, or heavy or light chain sequences. In some embodiments, any sequence having at least 80%, 81%, 82%, 83%, 84%, 85%, 86%, 87%, 88%, 89%, 90%, 91%, 92%, 93%, 94%, 95%, 96%, 97%, 98%, 99%, or 100% sequence identity to any of the sequences disclosed herein may be used. In some embodiments, any sequence having at least 0, 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, or 50 substitutions, deletions, or additions relative to any of the sequences disclosed herein may be used. The changes in sequences may apply to, for example, single amino acids, single nucleic acid bases, or nucleic acid codons; however, differences in longer stretches of sequences are also envisioned. As applied to antibody sequences, these differences in sequences may apply to antigen-binding regions (e.g., CDRs) or regions that do not bind to antigens or are only secondary to antigen binding (e.g., framework regions).

As disclosed herein, sequences having a % homology to any of the sequences disclosed herein are envisioned and may be used. The term "% homology" refers to the degree of conservation between two sequences when considering their three-dimensional structure. For example, homology between two protein sequences may be dependent on structural motifs, such as beta strands, alpha helices, and other folds, as well as their distribution throughout the sequence. Homology may be determined through structural determination, either empirically or in silico. In some embodiments, any sequence having at least 80%, 81%, 82%, 83%, 84%, 85%, 86%, 87%, 88%, 89%, 90%, 91%, 92%, 93%, 94%, 95%, 96%, 97%, 98%, 99%, or 100% sequence homology to any of the sequences disclosed herein may be used. In some embodiments, any sequence having at least 0, 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, or 50 substitutions, deletions, or additions relative to any of the sequences disclosed herein, which may or may not affect the overall % homology, may be used.

As applied herein, sequences having a certain % similarity to any of the sequence disclosed herein are envisioned and may be used. In some embodiments, these sequences may include peptide sequences, nucleic acid sequences, CDR sequences, variable region sequences, or heavy or light chain sequences. As understood in the art with respect to peptide sequences, "similarity" refers to the comparison of amino acids based on their properties, including but not limited to size, polarity, charge, pK, aromaticity, hydrogen bonding properties, or presence of functional groups (e.g. hydroxyl, thiol, amine, carboxyl, and the like). The term "% similarity" refers to the percentage of units (i.e. amino acids) that are the same between two or more sequences relative to the length of the sequence. When the two or more sequences being compared are the same length, the % similarity will be respective that length. When two or more sequences being compared are different lengths, deletions and/or insertions may be introduced to obtain the best alignment. The similarity of two amino acids may dictate whether a certain substitution is conservative or non-conservative. Methods of determining the conservativeness of an amino acid substitution are generally known in the art and may involve substitution matrices. Commonly used substitution matrices include BLOSUM45, BLOSUM62, BLOSUM80, PAM100, PAM120, PAM160, PAM200, PAM250, but other substitution matrices or approaches may be used as considered appropriate by the skilled person. A certain substitution matrix may be preferential over the others when considering aspects such as stringency, conservation and/or divergence of related sequences (e.g. within the same species or broader), and length of the sequences in question. As used herein, a peptide sequence having a certain % similarity to another sequence will have up to that % of amino acids that are either identical or an acceptable substitution as governed by the method of similarity determination used. In some embodiments, a sequence having at least 80%, 81%, 82%, 83%, 84%, 85%, 86%, 87%, 88%, 89%, 90%, 91%, 92%, 93%, 94%, 95%, 96%, 97%, 98%, 99%, or 100% sequence similarity to any of the sequences disclosed herein may be used. In some embodiments, any sequence having at least 0, 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, or 50 similar substitutions relative to any of the sequences disclosed herein may be used. As applied to antibody sequences, these similar substitutions may apply to antigen-binding regions (i.e. CDRs) or regions that do not bind to antigens or are only secondary to antigen binding (i.e. framework regions).

The term "consensus sequence" as used herein with regard to sequences refers to the generalized sequence representing all of the different combinations of permissible amino acids at each location of a group of sequences. A consensus sequence may provide insight into the conserved regions of related sequences where the unit (e.g. amino acid or nucleotide) is the same in most or all of the sequences, and regions that exhibit divergence between sequences. In the case of antibodies, the consensus sequence of a CDR may indicate amino acids that are important or dispensable for antigen binding. It is envisioned that consensus sequences may be prepared with any of the sequences provided herein, and the resultant various sequences derived from the consensus sequence can be validated to have similar effects as the template sequences.

The term "compete," as used herein with regard to an antibody, means that a first antibody, or an antigen-binding portion thereof, binds to an epitope in a manner sufficiently similar to the binding of a second antibody, or an antigen-binding portion thereof, such that the result of binding of the first antibody with its cognate epitope is detectably decreased in the presence of the second antibody compared to the binding of the first antibody in the absence of the second antibody. The alternative, where the binding of the second antibody to its epitope is also detectably decreased in the presence of the first antibody, can, but need not be the case. That is, a first antibody can inhibit the binding of a second antibody to its epitope without that second antibody inhibiting the binding of the first antibody to its respective epitope. However, where each antibody detectably inhibits the binding of the other antibody with its cognate epitope or ligand, whether to the same, greater, or lesser extent, the antibodies are said to "cross-compete" with each other for binding of their respective epitope(s). Both competing and cross-competing antibodies are encompassed by the present invention. Regardless of the mechanism by which such competition or cross-competition occurs (e.g., steric hindrance, conformational change, or binding to a common epitope, or portion thereof), the skilled artisan would appreciate, based upon the teachings provided herein, that such competing and/or cross-competing antibodies are encompassed and can be useful for the methods disclosed herein.

An antibody that "preferentially binds" or "specifically binds" (used interchangeably herein) to an epitope is a term well understood in the art, and methods to determine such specific or preferential binding are also well known in the art. A molecule is said to exhibit "specific binding" or "preferential binding" if it reacts or associates more frequently, and/or more rapidly, and/or with greater duration and/or with greater affinity with a particular cell or substance than it does with alternative cells or substances. An antibody "specifically binds" or "preferentially binds" to a target if it binds with greater affinity, and/or avidity, and/or more readily, and/or with greater duration than it binds to other substances. For example, an antibody that specifically or preferentially binds to a CFD epitope is an antibody that binds this epitope with greater affinity, and/or avidity, and/or more readily, and/or with greater duration than it binds to other CFD epitopes or non-CFD epitopes. It is also understood by reading this definition that, for example, an antibody (or moiety or epitope) that specifically or preferentially binds to a first target may or may not specifically or preferentially bind to a second target. As such, "specific binding" or "preferential binding" does not necessarily require (although it can include) exclusive binding. Generally, but not necessarily, reference to binding means preferential binding.

As used herein, the term "antigen binding molecule" refers to a molecule that comprises an antigen binding portion that binds to an antigen and, optionally, a scaffold or framework portion that allows the antigen binding portion to adopt a conformation that promotes binding of the antigen binding portion or provides some additional properties to the antigen binding molecule. In some embodiments, the antigen is Gal3. In some embodiments, the antigen binding portion comprises at least one CDR from an antibody that binds to the antigen. In some embodiments, the antigen binding portion comprises all three CDRs from a heavy chain of an antibody that binds to the antigen or from a light chain of an antibody that binds to the antigen. In some embodiments, the antigen binding portion comprises all six CDRs from an antibody that binds to the antigen (three from the heavy chain and three from the light chain). In some embodiments, the antigen binding portion is an antibody fragment.

Non-limiting examples of antigen binding molecules include antibodies, antibody fragments (e.g., an antigen binding fragment of an antibody), antibody derivatives, and antibody analogs. Further specific examples include, but are not limited to, a single-chain variable fragment (scFv), a nanobody (e.g. VH domain of camelid heavy chain antibodies; VHH fragment, see Cortez-Retamozo et al., Cancer Research, Vol. 64:2853-57, 2004), a Fab fragment, a Fab' fragment, a F(ab')2 fragment, a Fv fragment, a Fd fragment, and a complementarity determining region (CDR) fragment. These molecules can be derived from any mammalian source, such as human, mouse, rat, rabbit, pig, dog, cat, horse, donkey, guinea pig, goat, or camelid. Antibody fragments may compete for binding of a target antigen with an intact antibody and the fragments may be produced by the modification of intact antibodies (e.g. enzymatic or chemical cleavage) or synthesized de novo using recombinant DNA technologies or peptide synthesis. The antigen binding molecule can comprise, for example, an alternative protein scaffold or artificial scaffold with grafted CDRs or CDR derivatives. Such scaffolds include, but are not limited to, antibody-derived scaffolds comprising mutations introduced to, for example, stabilize the three-dimensional structure of the antigen binding molecule as well as wholly synthetic scaffolds comprising, for example, a biocompatible polymer. See, for example, Korndorfer et al., 2003, Proteins: Structure, Function, and Bioinformatics, Volume 53, Issue 1:121-129 (2003); Roque et al., Biotechnol. Prog. 20:639-654 (2004). In addition, peptide antibody mimetics ("PAMs") can be used, as well as scaffolds based on antibody mimetics utilizing fibronectin components as a scaffold.

An antigen binding molecule can also include a protein comprising one or more antibody fragments incorporated into a single polypeptide chain or into multiple polypeptide chains. For instance, antigen binding molecule can include, but are not limited to, a diabody (see, e.g., EP 404,097; WO 93/11161; and Hollinger et al., Proc. Natl. Acad. Sci. USA, Vol. 90:6444-6448, 1993); an intrabody; a domain antibody (single VL or VH domain or two or more VH domains joined by a peptide linker; see Ward et al., Nature, Vol. 341:544-546, 1989); a maxibody (2 scFvs fused to Fc region, see Fredericks et al., Protein Engineering, Design & Selection, Vol. 17:95-106, 2004 and Powers et al., Journal of Immunological Methods, Vol. 251:123-135, 2001); a triabody; a tetrabody; a minibody (scFv fused to CH3 domain; see Olafsen et al., Protein Eng Des Sel., Vol. 17:315-23, 2004); a peptibody (one or more peptides attached to an Fc region, see WO 00/24782); a linear antibody (a pair of tandem Fd segments (VH-CH1-VH-CH1) which, together with complementary light chain polypeptides, form a pair of antigen binding regions, see Zapata et al., Protein Eng., Vol. 8:1057-1062, 1995); a small modular immunopharmaceutical (see U.S. Patent Publication No. 20030133939); and immunoglobulin fusion proteins (e.g. IgG-scFv, IgG-Fab, 2scFv-IgG, 4scFv-IgG, VH-IgG, IgG-VH, and Fab-scFv-Fc).

In certain embodiments, an antigen binding molecule can have, for example, the structure of an immunoglobulin. An "immunoglobulin" is a tetrameric molecule, with each tetramer comprising two identical pairs of polypeptide chains, each pair having one "light" (about 25 kDa) and one "heavy" chain (about 50-70 kDa). The amino-terminal portion of each chain includes a variable region of about 100 to 110 or more amino acids primarily responsible for antigen recognition. The carboxy-terminal portion of each chain defines a constant region primarily responsible for effector function.

Unless otherwise specified, the complementarity defining regions disclosed herein follow the IMGT definition. In some embodiments, the CDRs can instead by Kabat, Chothia, or other definitions accepted by those of skill in the art.

As used herein, the term "humanized" as applies to a non-human (e.g. rodent or primate) antibodies are hybrid immunoglobulins, immunoglobulin chains or fragments thereof which contain minimal sequence derived from non-human immunoglobulin.

As used herein, the terms "treating" or "treatment" (and as well understood in the art) means an approach for obtaining beneficial or desired results in a subject's condition, including clinical results. Beneficial or desired clinical results can include, but are not limited to, alleviation or amelioration of one or more symptoms or conditions, diminishment of the extent of a disease, stabilizing (i.e., not worsening) the state of disease, prevention of a disease's transmission or spread, delaying or slowing of disease progression, amelioration or palliation of the disease state, diminishment of the reoccurrence of disease, and remission, whether partial or total and whether detectable or undetectable. "Treating" and "treatment" as used herein also include prophylactic treatment. Treatment methods comprise administering to a subject a therapeutically effective amount of an active agent. The administering step may consist of a single administration or may comprise a series of administrations. The compositions are administered to the subject in an amount and for a duration sufficient to treat the patient. The length of the treatment period depends on a variety of factors, such as the severity of the condition, the age and genetic profile of the patient, the concentration of active agent, the activity of the compositions used in the treatment, or a combination thereof. It will also be appreciated that the effective dosage of an agent used for the treatment or prophylaxis may increase or decrease over the course of a particular treatment or prophylaxis regime. Changes in dosage may result and become apparent by standard diagnostic assays known in the art. In some embodiments, chronic administration may be required.

The terms "effective amount" or "effective dose" as used herein have their plain and ordinary meaning as understood in light of the specification, and refer to that amount of a recited composition or compound that results in an observable designated effect. Actual dosage levels of active ingredients in an active composition of the presently disclosed subject matter can be varied so as to administer an amount of the active composition or compound that is effective to achieve the designated response for a particular subject and/or application. The selected dosage level can vary based upon a variety of factors including, but not limited to, the activity of the composition, formulation, route of administration, combination with other drugs or treatments, severity of the condition being treated, and the physical condition and prior medical history of the subject being treated. In some embodiments, a minimal dose is administered, and dose is escalated in the absence of dose-limiting toxicity to a minimally effective amount. Determination and adjustment of an effective dose, as well as evaluation of when and how to make such adjustments, are contemplated herein.

In some non-limiting embodiments, an effective amount or effective dose of a composition or compound may relate to the amount or dose that provides a significant, measurable, or sufficient therapeutic effect towards the treatment of a coronavirus infection, such as a SARS-CoV-2 infection. In some embodiments, the effective amount or effective dose of a composition or compound may treat, ameliorate, or prevent the progression of inflammation, shortness of breath, fatigue, pulmonary damage, or other symptoms associated with a coronavirus infection, such as a SARS-CoV-2 infection. In some embodiments, the effective amount or effective dose of a composition or compound may treat, ameliorate, or prevent the progression of a pulmonary inflammatory disease, such as COPD, or an autoimmune disease, such as systemic lupus erythematosus. In some embodiments, the effective amount or effective dose of a composition or compound may treat, ameliorate, or prevent the progression of inflammation (which might not be associated with a viral or other pathogenic infection) and symptoms and/or causes thereof, including neutrophil activation and migration.

The term "administering" includes oral administration, topical contact, administration as a suppository, intravenous, intraperitoneal, intramuscular, intralesional, intrathecal, intranasal, or subcutaneous administration, or the implantation of a slow-release device, e.g., a mini-osmotic pump, to a subject. Administration is by any route, including parenteral and transmucosal (e.g., buccal, sublingual, palatal, gingival, nasal, vaginal, rectal, or transdermal). Parenteral administration includes, e.g., intravenous, intramuscular, intra-arteriole, intradermal, subcutaneous, intraperitoneal, intraventricular, and intracranial. Other modes of delivery include, but are not limited to, the use of liposomal formulations, intravenous infusion, transdermal patches, etc. By "co-administer" it is meant that a first compound described herein is administered at the same time, just prior to, or just after the administration of a second compound described herein.

As used herein, the term "therapeutic target" refers to a gene or gene product that, upon modulation of its activity (e.g., by modulation of expression, biological activity, and the like), can provide for modulation of the disease phenotype. As used throughout, "modulation" is meant to refer to an increase or a decrease in the indicated phenomenon (e.g., modulation of a biological activity refers to an increase in a biological activity or a decrease in a biological activity).

As used herein, "pharmaceutically acceptable" has its plain and ordinary meaning as understood in light of the specification and refers to carriers, excipients, and/or stabilizers that are nontoxic to the cell or mammal being exposed thereto at the dosages and concentrations employed or that have an acceptable level of toxicity. A "pharmaceutically acceptable" "diluent," "excipient," and/or "carrier" as used herein have their plain and ordinary meaning as understood in light of the specification and are intended to include any and all solvents, dispersion media, coatings, antibacterial and antifungal agents, isotonic and absorption delaying agents, and the like, compatible with administration to humans, cats, dogs, or other vertebrate hosts. Typically, a pharmaceutically acceptable diluent, excipient, and/or carrier is a diluent, excipient, and/or carrier approved by a regulatory agency of a Federal, a state government, or other regulatory agency, or listed in the U.S. Pharmacopeia or other generally recognized pharmacopeia for use in animals, including humans as well as non-human mammals, such as cats and dogs. The term diluent, excipient, and/or carrier can refer to a diluent, adjuvant, excipient, or vehicle with which the pharmaceutical formulation is administered. Such pharmaceutical diluent, excipient, and/or carriers can be sterile liquids, such as water and oils, including those of petroleum, animal, vegetable or synthetic origin. Water, saline solutions and aqueous dextrose and glycerol solutions can be employed as liquid diluents, excipients, and/or carriers, particularly for injectable solutions. Suitable pharmaceutical diluents and/or excipients include sugars, starch, glucose, fructose, lactose, sucrose, maltose, gelatin, malt, rice, flour, chalk, silica gel, sodium stearate, glycerol monostearate, talc, salts, sodium chloride, dried skim milk, glycerol, propylene, glycol, water, ethanol and the like. A non-limiting example of a physiologically acceptable carrier is an aqueous pH buffered solution. The physiologically acceptable carrier may also comprise one or more of the following: antioxidants, such as ascorbic acid, low molecular weight (less than about 10 residues) polypeptides, proteins, such as serum albumin, gelatin, immunoglobulins, hydrophilic polymers such as polyvinylpyrrolidone, amino acids, carbohydrates such as glucose, mannose, or dextrins, chelating agents such as EDTA, sugar alcohols such as glycerol, erythritol, threitol, arabitol, xylitol, ribitol, mannitol, sorbitol, galactitol, fucitol, iditol, inositol, isomalt, maltitol, or lactitol, salt-forming counterions such as sodium, and non-ionic surfactants such as TWEEN®, polyethylene glycol (PEG), and PLURONICS®. The formulation, if desired, can also contain minor amounts of wetting, bulking, emulsifying agents, or pH buffering agents. These formulations can take the form of solutions, suspensions, emulsion, sustained release formulations and the like. The formulation should suit the mode of administration.

The term "pharmaceutically acceptable salts" has its plain and ordinary meaning as understood in light of the specification and includes relatively non-toxic, inorganic and organic acid, or base addition salts of compositions or excipients, including without limitation, analgesic agents, therapeutic agents, other materials, and the like. Examples of pharmaceutically acceptable salts include those derived from mineral acids, such as hydrochloric acid and sulfuric acid, and those derived from organic acids, such as ethanesulfonic acid, benzenesulfonic acid, p-toluenesulfonic acid, and the like. Examples of suitable inorganic bases for the formation of salts include the hydroxides, carbonates, and bicarbonates of ammonia, sodium, lithium, potassium, calcium, magnesium, aluminum, zinc, and the like. Salts may also be formed with suitable organic bases, including those that are non-toxic and strong enough to form such salts. For example, the class of such organic bases may include but are not limited to mono-, di-, and trialkylamines, including methylamine, dimethylamine, and triethylamine; mono-, di-, or trihydroxyalkylamines including mono-, di-, and triethanolamine; amino acids, including glycine, arginine and lysine; guanidine; N-methylglucosamine; N-methylglucamine; L-glutamine; N-methylpiperazine; morpholine; ethylenediamine; N-benzylphenethylamine; trihydroxymethyl aminoethane.

As used herein, a "carrier" refers to a compound, particle, solid, semi-solid, liquid, or diluent that facilitates the passage, delivery and/or incorporation of a compound to cells, tissues and/or bodily organs. For example, without limitation, a lipid nanoparticle (LNP) is a type of carrier that can encapsulate an oligonucleotide to thereby protect the oligonucleotide from degradation during passage through the bloodstream and/or to facilitate delivery to a desired organ, such as to the lungs.

As used herein, a "diluent" refers to an ingredient in a pharmaceutical composition that lacks pharmacological activity but may be pharmaceutically necessary or desirable. For example, a diluent may be used to increase the bulk of a potent drug whose mass is too small for manufacture and/or administration. It may also be a liquid for the dissolution of a drug to be administered by injection, ingestion or inhalation. A common form of diluent in the art is a buffered aqueous solution such as, without limitation, phosphate buffered saline that mimics the composition of human blood.

The term "excipient" has its ordinary meaning as understood in light of the specification, and refers to inert substances, compounds, or materials added to a pharmaceutical composition to provide, without limitation, bulk, consistency, stability, binding ability, lubrication, disintegrating ability etc., to the composition. Excipients with desirable properties include but are not limited to preservatives, adjuvants, stabilizers, solvents, buffers, diluents, solubilizing agents, detergents, surfactants, chelating agents, antioxidants, alcohols, ketones, aldehydes, ethylenediaminetetraacetic acid (EDTA), citric acid, salts, sodium chloride, sodium bicarbonate, sodium phosphate, sodium borate, sodium citrate, potassium chloride, potassium phosphate, magnesium sulfate sugars, dextrose, dextran, fructose, mannose, lactose, galactose, sucrose, sorbitol, cellulose, methyl cellulose, hydroxypropyl methyl cellulose (hypromellose), glycerin, polyvinyl alcohol, povidone, propylene glycol, serum, amino acids, polyethylene glycol, polysorbate 20, polysorbate 80, sodium deoxycholate, sodium taurodeoxycholate, magnesium stearate, octylphenol ethoxylate, benzethonium chloride, thimerosal, gelatin, esters, ethers, 2-phenoxyethanol, urea, or vitamins, or any combination thereof. The amount of the excipient may be found in a pharmaceutical composition at a percentage of 0%, 0.1%, 0.2%, 0.3%, 0.4%, 0.5%, 0.6%, 0.7%, 0.8%, 0.9%, 1%, 2%, 3%, 4%, 5%, 6%, 7%, 8%, 9%, 10%, 20%, 30%, 40%, 50%, 60%, 70%, 80%, 90%, 95%, 100% w/w or any percentage by weight in a range defined by any two of the aforementioned numbers.

Additional excipients with desirable properties include but are not limited to preservatives, adjuvants, stabilizers, solvents, buffers, diluents, solubilizing agents, detergents, surfactants, chelating agents, antioxidants, alcohols, ketones, aldehydes, ethylenediaminetetraacetic acid (EDTA), tris(hydroxymethyl)aminomethane (Tris), citric acid, ascorbic acid, acetic acid, salts, phosphates, citrates, acetates, succinates, chlorides, bicarbonates, borates, sulfates, sodium chloride, sodium bicarbonate, sodium phosphate, sodium borate, sodium citrate, potassium chloride, potassium phosphate, magnesium sulfate sugars, dextrose, dextran 40, fructose, mannose, lactose, trehalose, galactose, sucrose, sorbitol, mannitol, cellulose, serum, amino acids, alanine, arginine, asparagine, aspartic acid, cysteine, glutamine, glutamic acid, glycine, histidine, isoleucine, leucine, lysine, methionine, phenylalanine, proline, serine, threonine, tryptophan, tyrosine, valine, polysorbate 20, polysorbate 40, polysorbate, 60, polysorbate 80, poloxamer, poloxamer 188, sodium deoxycholate, sodium taurodeoxycholate, magnesium stearate, octylphenol ethoxylate, benzethonium chloride, thimerosal, gelatin, esters, ethers, 2-phenoxyethanol, urea, or vitamins, or any combination thereof. Some excipients may be in residual amounts or contaminants from the process of manufacturing, including but not limited to serum, albumin, ovalbumin, antibiotics, inactivating agents, formaldehyde, glutaraldehyde, β-propiolactone, gelatin, cell debris, nucleic acids, peptides, amino acids, or growth medium components or any combination thereof. The amount of the excipient may be found in the formulation at a percentage that is at least 0%, 0.1%, 0.2%, 0.3%, 0.4%, 0.5%, 0.6%, 0.7%, 0.8%, 0.9%, 1%, 2%, 3%, 4%, 5%, 6%, 7%, 8%, 9%, 10%, 20%, 30%, 40%, 50%, 60%, 70%, 80%, 90%, 95%, 100% w/w or any percentage by weight in a range defined by any two of the aforementioned numbers.

The term "adjuvant" as used herein refers to a substance, compound, or material that stimulates the immune response and increase the efficacy of protective immunity and is administered in conjunction with an immunogenic antigen, epitope, or composition. Adjuvants serve to improve immune responses by enabling a continual release of antigen, up-regulation of cytokines and chemokines, cellular recruitment at the site of administration, increased antigen uptake and presentation in antigen presenting cells, or activation of antigen presenting cells and inflammasomes. Commonly used adjuvants include but are not limited to alum, aluminum salts, aluminum sulfate, aluminum hydroxide, aluminum phosphate, calcium phosphate hydroxide, potassium aluminum sulfate, oils, mineral oil, paraffin oil, oil-in-water emulsions, detergents, MF59®, squalene, AS03, α-tocopherol, polysorbate 80, AS04, monophosphoryl lipid A, virosomes, nucleic acids, polyinosinic:polycytidylic acid, saponins, QS-21, proteins, flagellin, cytokines, chemokines, IL-1, IL-2, IL-12, IL-15, IL-21, imidazoquinolines, CpG oligonucleotides, lipids, phospholipids, dioleoyl phosphatidylcholine (DOPC), trehalose dimycolate, peptidoglycans, bacterial extracts, lipopolysaccharides, or Freund's Adjuvant, or any combination thereof.

The term "purity" of any given substance, compound, or material as used herein refers to the actual abundance of the substance, compound, or material relative to the expected abundance. For example, the substance, compound, or material may be at least 80, 85, 90, 91, 92, 93, 94, 95, 96, 97, 98, 99, or 100% pure, including all decimals in between. Purity may be affected by unwanted impurities, including but not limited to side products, isomers, enantiomers, degradation products, solvent, carrier, vehicle, or contaminants, or any combination thereof. Purity can be measured technologies including but not limited to chromatography, liquid chromatography, gas chromatography, spectroscopy, UV-visible spectrometry, infrared spectrometry, mass spectrometry, nuclear magnetic resonance, gravimetry, or titration, or any combination thereof.

The term "immune cells" refers to cells of hematopoietic origin that are involved in the specific recognition of antigens. Immune cells include antigen presenting cells (APCs), such as dendritic cells or macrophages, B cells, T cells, natural killer cells, and myeloid cells, such as monocytes, macrophages, eosinophils, mast cells, basophils, and granulocytes.

The term "immune response" refers to T cell-mediated and/or B cell-mediated immune responses. Exemplary immune responses include B cell responses (e.g., antibody production) T cell responses (e.g., cytokine production, and cellular cytotoxicity) and activation of cytokine responsive cells, e.g., macrophages. The term "activating immune response" refers to enhancing the level of T-cell-mediated and/or B cell-mediated immune response, using methods known to one of skilled in the art. In one embodiment, the level of enhancement is at least 20-50%, alternatively at least 60%, at least 70%, at least 80%, at least 90%, at least 100%, at least 120%, at least 150%, or at least 200%.

As used herein, the term "standard of care", "best practice" and "standard therapy" refers to the treatment that is accepted by medical practitioners to be an appropriate, proper, effective, and/or widely used treatment for a certain disease. The standard of care of a certain disease depends on many different factors, including the biological effect of treatment, region or location within the body, patient status (e.g. age, weight, gender, hereditary risks, other disabilities, secondary conditions), toxicity, metabolism, bioaccumulation, therapeutic index, dosage, and other factors known in the art. Determining a standard of care for a disease is also dependent on establishing safety and efficacy in clinical trials as standardized by regulatory bodies such as the US Food and Drug Administration, International Council for Harmonisation, Health Canada, European Medicines Agency, Therapeutics Goods Administration, Central Drugs Standard Control Organization, National Medical Products Administration, Pharmaceuticals and Medical Devices Agency, Ministry of Food and Drug Safety, and the World Health Organization. The standard of care for a disease may include but is not limited to surgery, radiation, chemotherapy, targeted therapy, or immunotherapy.

The term "% w/w" or "% wt/wt" means a percentage expressed in terms of the weight of the ingredient or agent over the total weight of the composition multiplied by 100.

Exemplary Anti-Gal3 Antibodies and Binding Fragments Thereof

In some embodiments, antibodies or binding fragments thereof are provided. In some embodiments, the antibodies are anti-Gal3 antibodies or binding fragments thereof. In some embodiments, the anti-Gal3 antibodies or binding fragments thereof comprise a light chain variable region comprising a $V_L$-CDR1, a $V_L$-CDR2, and a $V_L$-CDR3. In some embodiments, the anti-Gal3 antibodies or binding fragments thereof comprises a heavy chain variable region comprising a $V_H$-CDR1, a $V_H$-CDR2, and a $V_H$-CDR3. In some embodiments, the $V_L$-CDR1 comprises an amino acid sequence having at least 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or 100% sequence identity to any amino acid sequence according to SEQ ID NOs: 170-220. In some embodiments, the $V_L$-CDR2 comprises an amino acid sequence having at least 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or 100% sequence identity to any amino acid sequence according to SEQ ID NOs: 221-247. In some embodiments, the $V_L$-CDR3 comprises an amino acid sequence having at least 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or 100% sequence identity to any amino acid sequence according to SEQ ID NOs: 248-296. In some embodiments, the $V_H$-CDR1 comprises an amino acid sequence having at least 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or 100% sequence identity to any amino acid sequence according to SEQ ID NOs: 27-70. In some embodiments, the $V_H$-CDR2 comprises an amino acid sequence having at least 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or 100% sequence identity to any amino acid sequence according to SEQ ID NOs: 71-111, 826. In some embodiments, the $V_H$-CDR3 comprises an amino acid sequence having at least 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or 100% sequence identity to any amino acid sequence according to SEQ ID NOs: 112-169, 827. In some embodiments, the antibodies comprise one or more sequences having at least 80%, 81%, 82%, 83%, 84%, 85%, 86%, 87%, 88%, 89%, 90%, 91%, 92%, 93%, 94%, 95%, 96%, 97%, 98%, 99%, or 100% identity to a VL sequence, a VH sequence, a VL/VH pairing, and/or $V_L$-CDR1, $V_L$-CDR2, $V_L$-CDR3, $V_H$-CDR1, $V_H$-CDR2, $V_H$-CDR3 (including 1, 2, 3, 4, or 5 amino acid substitutions of any one or more of these CDRs) set from the heavy chain and light chain sequences as depicted in FIG. 18.

In some embodiments, antibodies or binding fragments thereof are provided. In some embodiments, the antibodies or binding fragments thereof are anti-Gal3 antibodies or binding fragments thereof. In some embodiments, the anti-Gal3 antibodies or binding fragments thereof comprise a light chain variable region comprising a $V_L$-CDR1, a $V_L$-CDR2, and a $V_L$-CDR3. In some embodiments, the anti-Gal3 antibodies or binding fragments thereof comprises a heavy chain variable region comprising a $V_H$-CDR1, a $V_H$-CDR2, and a $V_H$-CDR3. In some embodiments, the $V_L$-CDR1 comprises an amino acid sequence having at least 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or 100% sequence similarity to any amino acid sequence according to SEQ ID NOs: 170-220. In some embodiments, the $V_L$-CDR2 comprises an amino acid sequence having at least 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or 100% sequence similarity to any amino acid sequence according to SEQ ID NOs: 221-247. In some embodiments, the $V_L$-CDR3 comprises an amino acid sequence having at least 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or 100% sequence similarity to any amino acid sequence according to SEQ ID NOs: 248-296. In some embodiments, the $V_H$-CDR1 comprises an amino acid sequence having at least 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or 100% sequence similarity to any amino acid sequence according to SEQ ID NOs: 27-70. In some embodiments, the $V_H$-CDR2 comprises an amino acid sequence having at least 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or 100% sequence similarity to any amino acid sequence according to SEQ ID NOs: 71-111, 826. In some embodiments, the $V_H$-CDR3 comprises an amino acid sequence having at least 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or 100% sequence similarity to any amino acid sequence according to SEQ ID NOs: 112-169, 827. In some embodiments, the antibodies comprise one or more sequences having at least 80%, 81%, 82%, 83%, 84%, 85%, 86%, 87%, 88%, 89%, 90%, 91%, 92%, 93%, 94%, 95%, 96%, 97%, 98%, 99%, or 100% similar to a VL sequence, a VH sequence, a VL/VH pairing, and/or $V_L$-CDR1, $V_L$-CDR2, $V_L$-CDR3, $V_H$-CDR1, $V_H$-CDR2, $V_H$-CDR3 (including 1, 2, 3, 4, or 5 amino acid substitutions of any one or more of these CDRs) set from the heavy chain and light chain sequences as depicted in FIG. 18.

In some embodiments, antibodies or binding fragments thereof are provided. In some embodiments, the antibodies or binding fragments thereof are anti-Gal3 antibodies or binding fragments thereof. In some embodiments, the anti-Gal3 antibodies or binding fragments thereof comprise a light chain variable region comprising a $V_L$-CDR1, a $V_L$-CDR2, and a $V_L$-CDR3. In some embodiments, the anti-Gal3 antibodies or binding fragments thereof comprises a heavy chain variable region comprising a $V_H$-CDR1, a $V_H$-CDR2, and a $V_H$-CDR3. In some embodiments, the $V_L$-CDR1 comprises an amino acid sequence having at least 0, 1, 2, 3, 4, 5, or 6 substitutions relative to any amino acid sequence according to SEQ ID NOs: 170-220. In some embodiments, the $V_L$-CDR2 comprises an amino acid sequence having at least 0, 1, 2, 3, 4, 5, or 6 substitutions relative to any amino acid sequence according to SEQ ID NOs: 221-247. In some embodiments, the $V_L$-CDR3 comprises an amino acid sequence having at least 0, 1, 2, 3, 4, 5, or 6 substitutions relative to any amino acid sequence according to SEQ ID NOs: 248-296. In some embodiments, the $V_H$-CDR1 comprises an amino acid sequence having at least 0, 1, 2, 3, 4, 5, or 6 substitutions relative to any amino acid sequence according to SEQ ID NOs: 27-70. In some embodiments, the $V_H$-CDR2 comprises an amino acid sequence having at least 0, 1, 2, 3, 4, 5, or 6 substitutions relative to any amino acid sequence according to SEQ ID NOs: 71-111, 826. In some embodiments, the $V_H$-CDR3 comprises an amino acid sequence having at least 0, 1, 2, 3, 4, 5, or 6 substitutions relative to any amino acid sequence according to SEQ ID NOs: 112-169, 827.

In some embodiments, the antibody or binding fragment thereof comprises a combination of a $V_L$-CDR1, a $V_L$-CDR2, a $V_L$-CDR3, a $V_H$-CDR1, a $V_H$-CDR2, and a $V_H$-CDR3 as illustrated in FIG. 14.

Figure 33A:
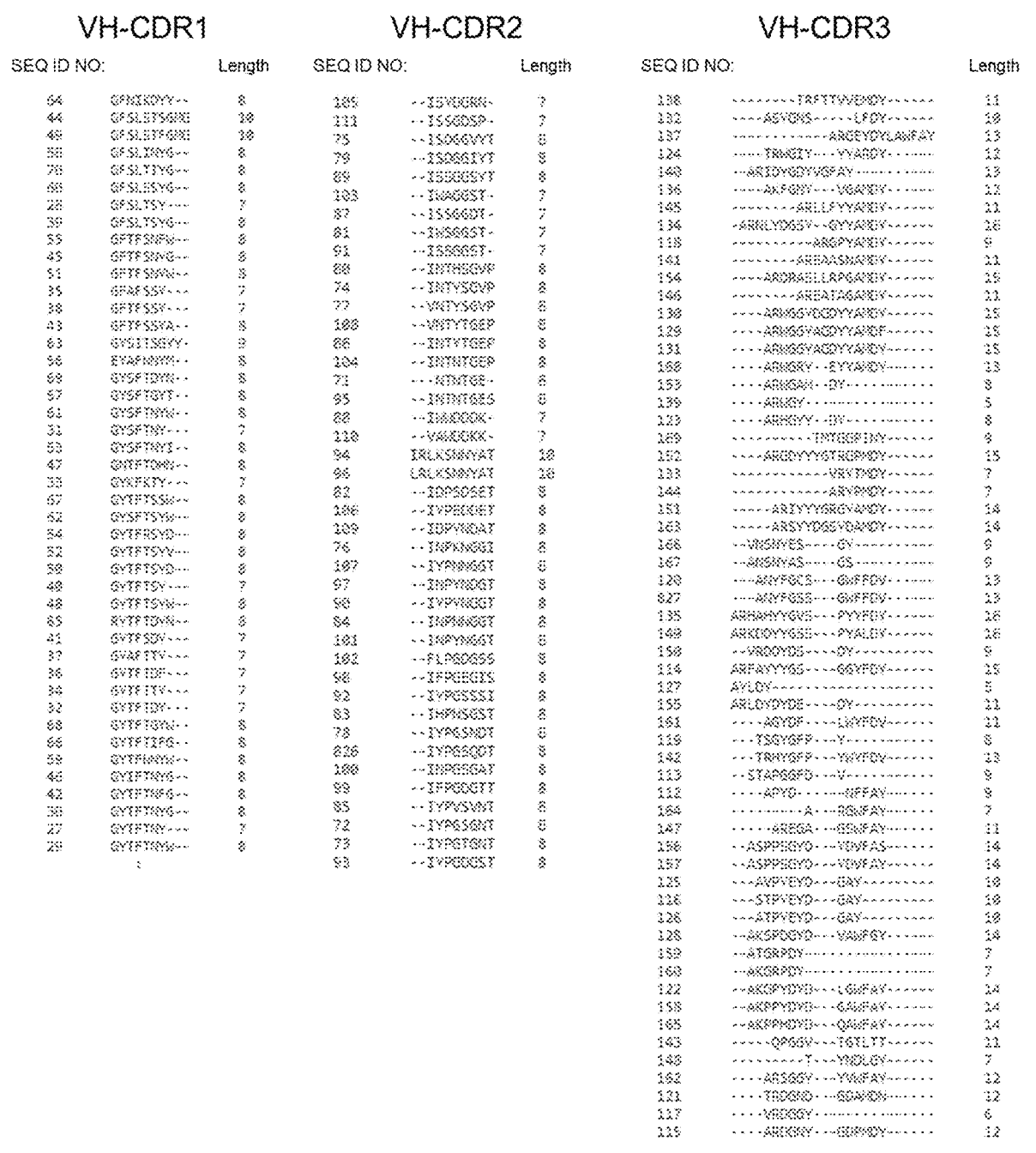

In some embodiments, the antibody or binding fragment thereof comprises a combination of a $V_L$-CDR1, a $V_L$-CDR2, a $V_L$-CDR3, a VH-CDR1, a VH-CDR2, and a VH-CDR3 where one or more of these CDRs is defined by a consensus sequence. The consensus sequences provided herein have been derived from the alignments of CDRs depicted in FIG. 33A-B. However, it is envisioned that alternative alignments may be done (e.g. using global or local alignment, or with different algorithms, such as Hidden Markov Models, seeded guide trees, Needleman-Wunsch algorithm, or Smith-Waterman algorithm) and as such, alternative consensus sequences can be derived.

In some embodiments, the $V_L$-CDR1 is defined by the formula $X_1X_2X_3X_4X_5X_6X_7X_8X_9X_{10}X_{11}X_{12}X_{13}X_{14}X_{15}X_{16}X_{17}$, where $X_1$ is no amino acid or R; $X_2$ is no amino acid or S; $X_3$ is no amino acid, S, or T; $X_4$ is no amino acid, E, G, K, Q, or R; $X_5$ is no amino acid, A, D, G, I, N, or S; $X_6$ is no amino acid, I, L, or V; $X_7$ is no amino acid, F, L, S, or V; $X_8$ is no amino acid, D, E, H, N, S, T, or Y; $X_9$ is no amino acid, D, E, I, K, N, R, S, T, or V; $X_{10}$ is no amino acid, D, H, N, R, S, or Y; $X_{11}$ is no amino acid, A, G, N, S, T, or V; $X_{12}$ is no amino acid, A, I, K, N, Q, T, V, or Y; $X_{13}$ is no amino acid, D, G, H, K, N, S, T, or Y; $X_{14}$ is no amino acid, C, F, I, N, S, T, V, or Y; $X_{15}$ is no amino acid, D, L, N, W, or Y; $X_{16}$ is no amino acid, N, or D; $X_{17}$ is no amino acid or D. In some embodiments, the $V_L$-CDR1 comprises a sequence having at least 80%, 81%, 82%, 83%, 84%, 85%, 86%, 87%, 88%, 89%, 90%, 91%, 92%, 93%, 94%, 95%, 96%, 97%, 98%, 99%, or 100% identity to this consensus sequence. In some embodiments, the $V_L$-CDR1 comprises a sequence having 0, 1, 2, 3, 4, 5, or 6 substitutions from this consensus sequence.

In some embodiments, the $V_L$-CDR2 is defined by the formula $X_1X_2X_3X_4X_5X_6X_7X_8$, where $X_1$ is no amino acid, K, L, N, Q, or R; $X_2$ is no amino acid, A, L, M, or V; $X_3$ is no amino acid, C, K, or S; $X_4$ is no amino acid or T; $X_5$ is no amino acid, A, E, F, G, H, K, Q, R, S, W, or Y; $X_6$ is no amino acid, A, G, or T; $X_7$ is no amino acid, I, K, N, S, or T; $X_8$ is no amino acid, N, or S. In some embodiments, the $V_L$-CDR2 comprises a sequence having at least 80%, 81%, 82%, 83%, 84%, 85%, 86%, 87%, 88%, 89%, 90%, 91%, 92%, 93%, 94%, 95%, 96%, 97%, 98%, 99%, or 100% identity to this consensus sequence. In some embodiments, the $V_L$-CDR2 comprises a sequence having 0, 1, 2, 3, 4, 5, or 6 substitutions from this consensus sequence.

In some embodiments, the $V_L$-CDR3 is defined by the formula $X_1X_2X_3X_4X_5X_6X_7X_8X_9X_{10}$, where $X_1$ is no amino acid, A, E, F, H, L, M, Q, S, V, or W; $X_2$ is A, H, or Q; $X_3$ is D, F, G, H, L, M, N, Q, S, T, W, or Y; $X_4$ is no amino acid or W; $X_5$ is A, D, I, K, L, N, Q, R, S, T, V, or Y; $X_6$ is D, E, H, I, K, L, N, Q, S, or T; $X_7$ is D, F, K, L, N, P, S, T, V, W, or Y; $X_8$ is H, P, or S; $X_9$ is F, L, P, Q, R, T, W, or Y; $X_{10}$ is no amino acid, T, or V. In some embodiments, the $V_L$-CDR3 comprises a sequence having at least 80%, 81%, 82%, 83%, 84%, 85%, 86%, 87%, 88%, 89%, 90%, 91%, 92%, 93%, 94%, 95%, 96%, 97%, 98%, 99%, or 100% identity to this consensus sequence. In some embodiments, the $V_L$-CDR3 comprises a sequence having 0, 1, 2, 3, 4, 5, or 6 substitutions from this consensus sequence.

In some embodiments, the VH-CDR1 is defined by the formula $X_1X_2X_3X_4X_5X_6X_7X_8X_9X_{10}$, where $X_1$ is E, G, or R; $X_2$ is F, N, or Y; $X_3$ is A, I, K, N, S, or T; $X_4$ is F, I, or L; $X_5$ is I, K, N, R, S, or T; $X_6$ is D, G, I, N, S, or T; $X_7$ is F, G, H, S, or Y; $X_8$ is no amino acid, A, D, G, I, M, N, T, V, W, or Y; $X_9$ is no amino acid, M, or Y; $X_{10}$ is no amino acid or G; In some embodiments, the $V_H$-CDR1 comprises a sequence having at least 80%, 81%, 82%, 83%, 84%, 85%, 86%, 87%, 88%, 89%, 90%, 91%, 92%, 93%, 94%, 95%, 96%, 97%, 98%, 99%, or 100% identity to this consensus sequence. In some embodiments, the $V_H$-CDR1 comprises a sequence having 0, 1, 2, 3, 4, 5, or 6 substitutions from this consensus sequence.

In some embodiments, the $V_H$-CDR2 is defined by the formula $X_1X_2X_3X_4X_5X_6X_7X_8X_9X_{10}$, where $X_1$ is no amino acid, I, or L; $X_2$ is no amino acid or R; $X_3$ is no amino acid, F, I, L, or V; $X_4$ is A, D, F, H, K, L, N, S, W, or Y; $X_5$ is A, D, P, S, T, W, or Y; $X_6$ is D, E, G, H, K, N, S, V, or Y; $X_7$ is D, E, G, N, S, or T; $X_8$ is D, G, I, K, N, Q, R, S, V, or Y; $X_9$ is A, D, E, G, I, K, N, P, S, T, V, or Y; $X_{10}$ is no amino acid, I, P, S, or T. In some embodiments, the $V_H$-CDR2 comprises a sequence having at least 80%, 81%, 82%, 83%, 84%, 85%, 86%, 87%, 88%, 89%, 90%, 91%, 92%, 93%, 94%, 95%, 96%, 97%, 98%, 99%, or 100% identity to this consensus sequence. In some embodiments, the $V_H$-CDR2 comprises a sequence having 0, 1, 2, 3, 4, 5, or 6 substitutions from this consensus sequence.

In some embodiments, the $V_H$-CDR3 is defined by the formula $X_1X_2X_3X_4X_5X_6X_7X_8X_9X_{10}X_{11}X_{12}X_{13}X_{14}X_{15}X_{16}X_{17}X_{18}X_{19}X_{20}X_{21}X_{22}X_{23}X_{24}X_{25}$, where $X_1$ is no amino acid or A; $X_2$ is no amino acid, A, R, or Y; $X_3$ is no amino acid, A, F, H, K, L, R, S, or V; $X_4$ is no amino acid, A, D, K, N, R, S, or T; $X_5$ is no amino acid, A, D, G, H, I, L, N, P, R, S, T, V, or Y; $X_6$ is no amino acid, A, D, G, H, K, N, P, Q, R, S, or Y; $X_7$ is no amino acid, D, F, G, H, P, R, S, W, or Y; $X_8$ is no amino acid, A, D, E, G, I, R, or S; $X_9$ is no amino acid, A, C, D, E, F, G, I, N, R, S, T, V, or Y; $X_{10}$ is no amino acid, A, D, M, P, R, S, T, V, or Y; $X_{11}$ is no amino acid, A, D, E, F, L, T, V, or Y; $X_{12}$ is no amino acid, A, G, L, M, R, or T; $X_{13}$ is no amino acid, A, D, E, F, G, R, S, T, or V; $X_{14}$ is no amino acid, A, D, G, L, P, Q, R, S, T, V, or Y; $X_{15}$ is no amino acid, A, D, G, N, S, V, W, or Y; $X_{16}$ is no amino acid, A, D, E, F, L, P, T, V, W, or Y; $X_{17}$ is no amino acid, F, I, L, M, R, or Y; $X_{18}$ is no amino acid, A, D, G, N, or T; $X_{19}$ is no amino acid, F, N, S, T, V, or Y; $X_{20}$ is no amino acid or L; $X_{21}$ is no amino acid or A; $X_{22}$ is no amino acid or W; $X_{23}$ is no amino acid or F; $X_{24}$ is no amino acid or A; $X_{25}$ is no amino acid or Y. In some embodiments, the $V_H$-CDR3 comprises a sequence having at least 80%, 81%, 82%, 83%, 84%, 85%, 86%, 87%, 88%, 89%, 90%, 91%, 92%, 93%, 94%, 95%, 96%, 97%, 98%, 99%, or 100% identity to this consensus sequence. In some embodiments, the $V_H$-CDR3 comprises a sequence having 0, 1, 2, 3, 4, 5, or 6 substitutions from this consensus sequence.

In some embodiments, the light chain variable region of the antibody or binding fragment thereof comprises a sequence having at least 80%, 81%, 82%, 83%, 84%, 85%, 86%, 87%, 88%, 89%, 90%, 91%, 92%, 93%, 94%, 95%, 96%, 97%, 98%, or 99% identity to the sequence selected from SEQ ID NOs: 374-447, 823-825. In some embodiments, the light chain variable region of the anti-Gal3 antibody or binding fragment thereof comprises the sequence selected from SEQ ID NOs: 374-447, 823-825. In some embodiments, the heavy chain variable region of the anti-Gal3 antibody or binding fragment thereof comprises a sequence having at least 80%, 81%, 82%, 83%, 84%, 85%, 86%, 87%, 88%, 89%, 90%, 91%, 92%, 93%, 94%, 95%, 96%, 97%, 98%, or 99% identity to the sequence selected from SEQ ID NOs: 297-373, 822, 828. In some embodiments, the heavy chain variable region of the antibody or binding fragment thereof comprises the sequence selected from SEQ ID NOs: 297-373, 822, 828. In some embodiments, the antibodies or binding fragments thereof are anti-Gal3 antibodies or binding fragments thereof.

In some embodiments, the light chain variable region of the antibody or binding fragment thereof comprises a sequence having at least 80%, 81%, 82%, 83%, 84%, 85%, 86%, 87%, 88%, 89%, 90%, 91%, 92%, 93%, 94%, 95%, 96%, 97%, 98%, or 99% similarity to the sequence selected from SEQ ID NOs: 374-447, 823-825. In some embodiments, the light chain variable region of the anti-Gal3 antibody or binding fragment thereof comprises the sequence selected from SEQ ID NOs: 374-447, 823-825. In some embodiments, the heavy chain variable region of the anti-Gal3 antibody or binding fragment thereof comprises a sequence having at least 80%, 81%, 82%, 83%, 84%, 85%, 86%, 87%, 88%, 89%, 90%, 91%, 92%, 93%, 94%, 95%, 96%, 97%, 98%, or 99% similarity to the sequence selected from SEQ ID NOs: 297-373, 822, 828. In some embodiments, the heavy chain variable region of the anti-Gal3 antibody or binding fragment thereof comprises the sequence selected from SEQ ID NOs: 297-373, 822, 828. In some embodiments, the antibodies or binding fragments thereof are anti-Gal3 antibodies or binding fragments thereof. In some embodiments, the antibodies comprise one or more sequences having at least 80%, 81%, 82%, 83%, 84%, 85%, 86%, 87%, 88%, 89%, 90%, 91%, 92%, 93%, 94%, 95%, 96%, 97%, 98%, 99%, or 100% identity to a VL sequence, a VH sequence, a VL/VH pairing, and/or $V_L$-CDR1, $V_L$-CDR2, $V_L$-CDR3, $V_H$-CDR1, $V_H$-CDR2, $V_H$-CDR3 (including 1, 2, 3, 4, or 5 amino acid substitutions of any one or more of these CDRs) set from the heavy chain and light chain sequences as depicted in FIG. 18.

In some embodiments, antibodies or binding fragments thereof are provided. In some embodiments, the antibodies are anti-Gal3 antibodies or binding fragments thereof. In some embodiments, the anti-Gal3 antibodies or binding fragments thereof comprise a light chain variable region comprising a $V_L$-CDR1, a $V_L$-CDR2, and a $V_L$-CDR3. In some embodiments, the anti-Gal3 antibodies or binding fragments thereof comprises a heavy chain variable region comprising a $V_H$-CDR1, a $V_H$-CDR2, and a $V_H$-CDR3. In some embodiments, the $V_L$-CDR1 comprises one of the amino acid sequences of SEQ ID NOs: 170-220, the $V_L$-CDR2 comprises one of the amino acid sequences of SEQ ID NOs: 211-247, the $V_L$-CDR3 comprises one of the amino acid sequences of SEQ ID NOs: 248-296, the $V_H$-CDR1 comprises one of the amino acid sequences of SEQ ID NOs: 27-70, the $V_H$-CDR2 comprises one of the amino acid sequences of SEQ ID NOs: 71-111, 826, and the $V_H$-CDR3 comprises one of the amino acid sequences of SEQ ID NO: 112-169, 827, the light chain variable region has a sequence having at least 80%, 81%, 82%, 83%, 84%, 85%, 86%, 87%, 88%, 89%, 90%, 91%, 92%, 93%, 94%, 95%, 96%, 97%, 98%, 99%, or 100% identity to one of the amino acid sequences of SEQ ID NOs: 374-447, 823-825, and the heavy chain variable region has a sequence having at least 80%, 81%, 82%, 83%, 84%, 85%, 86%, 87%, 88%, 89%, 90%, 91%, 92%, 93%, 94%, 95%, 96%, 97%, 98%, 99%, or 100% identity to one of the amino acid sequences of SEQ ID NOs: 297-373, 822, 828.

In some embodiments, the antibody or binding fragment thereof comprises a light chain, wherein the light chain comprises a sequence having at least 80%, 81%, 82%, 83%, 84%, 85%, 86%, 87%, 88%, 89%, 90%, 91%, 92%, 93%, 94%, 95%, 96%, 97%, 98%, or 99% identity to the sequence selected from SEQ ID NOs: 495-538, 830. In some embodiments, the light chain comprises the sequence selected from SEQ ID NOs: 495-538, 830. In some embodiments, the anti-Gal3 antibody or binding fragment thereof comprises a heavy chain, wherein the heavy chain comprises a sequence having at least 80%, 81%, 82%, 83%, 84%, 85%, 86%, 87%, 88%, 89%, 90%, 91%, 92%, 93%, 94%, 95%, 96%, 97%, 98%, or 99% identity to the sequence selected from SEQ ID NOs: 448-494, 829. In some embodiments, the heavy chain comprises the sequence selected from SEQ ID NOs: 448-494, 829. In some embodiments, the antibodies or binding fragments thereof are anti-Gal3 antibodies or binding fragments thereof.

In some embodiments, the antibody or binding fragment thereof comprises a light chain, wherein the light chain comprises a sequence having at least 80%, 81%, 82%, 83%, 84%, 85%, 86%, 87%, 88%, 89%, 90%, 91%, 92%, 93%, 94%, 95%, 96%, 97%, 98%, or 99% similarity to the sequence selected from SEQ ID NOs: 495-538, 830. In some embodiments, the light chain comprises the sequence selected from SEQ ID NOs: 495-538, 830. In some embodiments, the anti-Gal3 antibody or binding fragment thereof comprises a heavy chain, wherein the heavy chain comprises a sequence having at least 80%, 81%, 82%, 83%, 84%, 85%, 86%, 87%, 88%, 89%, 90%, 91%, 92%, 93%, 94%, 95%, 96%, 97%, 98%, or 99% similarity to the sequence selected from SEQ ID NOs: 448-494, 829. In some embodiments, the heavy chain comprises the sequence selected from SEQ ID NOs: 448-494, 829. In some embodiments, the antibodies or binding fragments thereof are anti-Gal3 antibodies or binding fragments thereof.

In some embodiments, antibodies or binding fragments thereof are provided. In some embodiments, the antibodies are anti-Gal3 antibodies or binding fragments thereof. In some embodiments, the anti-Gal3 antibodies or binding fragments thereof comprise a light chain variable region comprising a V$_L$-CDR1, a V$_L$-CDR2, and a V$_L$-CDR3. In some embodiments, the anti-Gal3 antibodies or binding fragments thereof comprises a heavy chain variable region comprising a V$_H$-CDR1, a V$_H$-CDR2, and a V$_H$-CDR3. In some embodiments, the V$_L$-CDR1 comprises one of the amino acid sequences of SEQ ID NOs: 170-220, the V$_L$-CDR2 comprises one of the amino acid sequences of SEQ ID NOs: 211-247, the V$_L$-CDR3 comprises one of the amino acid sequences of SEQ ID NOs: 248-296, the V$_H$-CDR1 comprises one of the amino acid sequences of SEQ ID NOs: 27-70, the V$_H$-CDR2 comprises one of the amino acid sequences of SEQ ID NOs: 71-111, 826, and the V$_H$-CDR3 comprises one of the amino acid sequences of SEQ ID NO: 112-169, 827, the light chain has a sequence having at least 80%, 81%, 82%, 83%, 84%, 85%, 86%, 87%, 88%, 89%, 90%, 91%, 92%, 93%, 94%, 95%, 96%, 97%, 98%, 99%, or 100% identity to one of the amino acid sequences of SEQ ID NOs: 495-538, 830, and the heavy chain has a sequence having at least 80%, 81%, 82%, 83%, 84%, 85%, 86%, 87%, 88%, 89%, 90%, 91%, 92%, 93%, 94%, 95%, 96%, 97%, 98%, 99%, or 100% identity to one of the amino acid sequences of SEQ ID NOs: 448-494, 829.

In some embodiments, antibodies or binding fragments thereof are provided. In some embodiments, the antibodies are anti-Gal3 antibodies or binding fragments thereof. In some embodiments, the anti-Gal3 antibodies or binding fragments thereof comprise a light chain variable region and a heavy chain variable region. In some embodiments, the light chain variable region is paired with an IgG4 kappa chain constant domain. In some embodiments, the IgG4 kappa chain constant domain comprises a sequence having at least 80%, 81%, 82%, 83%, 84%, 85%, 86%, 87%, 88%, 89%, 90%, 91%, 92%, 93%, 94%, 95%, 96%, 97%, 98%, 99%, or 100% identity to SEQ ID NO: 833. In some embodiments, the heavy chain variable region is paired with an IgG4 heavy chain constant domain or an IgG2 heavy chain constant domain. In some embodiments, the IgG4 heavy chain constant domain or IgG2 heavy chain constant domain are human or murine. In some embodiments, the IgG4 heavy chain constant domain comprises a sequence having at least 80%, 81%, 82%, 83%, 84%, 85%, 86%, 87%, 88%, 89%, 90%, 91%, 92%, 93%, 94%, 95%, 96%, 97%, 98%, 99%, or 100% identity to SEQ ID NO: 832. In some embodiments, the IgG4 heavy chain constant domain is an S228P mutant. In some embodiments, the IgG2 heavy chain constant domain comprises a sequence having at least 80%, 81%, 82%, 83%, 84%, 85%, 86%, 87%, 88%, 89%, 90%, 91%, 92%, 93%, 94%, 95%, 96%, 97%, 98%, 99%, or 100% identity to SEQ ID NO: 838 or SEQ ID NO: 839. In some embodiments, the IgG2 heavy chain constant domain is a LALAPG or a LALA mutant. In some embodiments, the light chain variable region and/or heavy chain variable region may be selected from those depicted in FIGS. 15 and 16 and/or the combinations of light chain variable region and heavy chain variable region as depicted in FIG. 17. In some embodiments, the light chain variable region and/or heavy chain variable regions comprise one or more CDRs depicted in FIGS. 8-13 and/or the combinations of CDRs depicted in FIG. 14.

In some embodiments, the antibody or binding fragment thereof is selected from the group consisting of: TB001, TB006, 12G5.D7, 13A12.2E5, 14H10.2C9, 15F10.2D6, 19B5.2E6, 20D11.2C6, 20H5.A3, 23H9.2E4, 2D10.2B2, 3B11.2G2, 7D8.2D8, mIMT001, 4A11.2B5, 4A11.H1L1, 4A11.H4L2, 4G2.2G6, 6B3.2D3, 6H6.2D6, 9H2.2H10, 13G4.2F8, 13H12.2F8, 15G7.2A7, 19D9.2E5, 23B10.2B12, 24D12.2H9, F846C.1B2, F846C.1F5, F846C.1H12, F846C.1H5, F846C.2H3, F846TC.14A2, F846TC.14E4, F846TC.16B5, F846TC.7F10, F847C.10B9, F847C.11B1, F847C.12F12, F847C.26F5, F847C.4B10, F849C.8D10, F849C.8H3, 846.2B11, 846.4D5, 846T.1H2, 847.14H4, 846.2D4, 846.2F11, 846T.10B1, 846T.2E3, 846T.4C9, 846T.4E11, 846T.4F5, 846T.8D1, 847.10C9, 847.11D6, 847.15D12, 847.15F9, 847.15H11, 847.20H7, 847.21B11, 847.27B9, 847.28D1, 847.2B8, 847.3B3, 849.1D2, 849.2D7, 849.2F12, 849.4B2, 849.4F12, 849.4F2, 849.5C2, 849.8D12, F847C.21H6, 849.5H1, 847.23F11, 847.16D10, 847.13E2-mH0mL1, 847.13E2-mH0mL2, 847.12C4, 847.4D3, 2D10-VH0-VL0, or binding fragment thereof.

In some embodiments, the antibody or binding fragment thereof comprises a sequence (e.g. CDR, VL, VH, LC, HC) having at least 80%, 81%, 82%, 83%, 84%, 85%, 86%, 87%, 88%, 89%, 90%, 91%, 92%, 93%, 94%, 95%, 96%, 97%, 98%, 99%, or 100% sequence identity to a sequence of TB001, TB006, 12G5.D7, 13A12.2E5, 14H10.2C9, 15F10.2D6, 19B5.2E6, 20D11.2C6, 20H5.A3, 23H9.2E4, 2D10.2B2, 3B11.2G2, 7D8.2D8, mIMT001, 4A11.2B5, 4A11.H1L1, 4A11.H4L2, 4G2.2G6, 6B3.2D3, 6H6.2D6, 9H2.2H10, 13G4.2F8, 13H12.2F8, 15G7.2A7, 19D9.2E5, 23B10.2B12, 24D12.2H9, F846C.1B2, F846C.1F5, F846C.1H12, F846C.1H5, F846C.2H3, F846TC.14A2, F846TC.14E4, F846TC.16B5, F846TC.7F10, F847C.10B9, F847C.11B1, F847C.12F12, F847C.26F5, F847C.4B10, F849C.8D10, F849C.8H3, 846.2B11, 846.4D5, 846T.1H2, 847.14H4, 846.2D4, 846.2F11, 846T.10B1, 846T.2E3, 846T.4C9, 846T.4E11, 846T.4F5, 846T.8D1, 847.10C9, 847.11D6, 847.15D12, 847.15F9, 847.15H11, 847.20H7, 847.21B11, 847.27B9, 847.28D1, 847.2B8, 847.3B3, 849.1D2, 849.2D7, 849.2F12, 849.4B2, 849.4F12, 849.4F2, 849.5C2, 849.8D12, F847C.21H6, 849.5H1, 847.23F11, 847.16D10, 847.13E2-mH0mL1, 847.13E2-mH0mL2, 847.12C4, 847.4D3, or 2D10-VH0-VL0.

In some embodiments, the antibody or binding fragment thereof comprises a sequence (e.g. CDR, VL, VH, LC, HC) having at least 80%, 81%, 82%, 83%, 84%, 85%, 86%, 87%, 88%, 89%, 90%, 91%, 92%, 93%, 94%, 95%, 96%, 97%, 98%, 99%, or 100% sequence similarity to a sequence of TB001, TB006, 12G5.D7, 13A12.2E5, 14H10.2C9, 15F10.2D6, 19B5.2E6, 20D11.2C6, 20H5.A3, 23H9.2E4, 2D10.2B2, 3B11.2G2, 7D8.2D8, mIMT001, 4A11.2B5, 4A11.H1L1, 4A11.H4L2, 4G2.2G6, 6B3.2D3, 6H6.2D6, 9H2.2H10, 13G4.2F8, 13H12.2F8, 15G7.2A7, 19D9.2E5, 23B10.2B12, 24D12.2H9, F846C.1B2, F846C.1F5, F846C.1H12, F846C.1H5, F846C.2H3, F846TC.14A2, F846TC.14E4, F846TC.16B5, F846TC.7F10, F847C.10B9, F847C.11B1, F847C.12F12, F847C.26F5, F847C.4B10, F849C.8D10, F849C.8H3, 846.2B11, 846.4D5, 846T.1H2, 847.14H4, 846.2D4, 846.2F11, 846T.10B1, 846T.2E3, 846T.4C9, 846T.4E11, 846T.4F5, 846T.8D1, 847.10C9, 847.11D6, 847.15D12, 847.15F9, 847.15H11, 847.20H7, 847.21B11, 847.27B9, 847.28D1, 847.2B8, 847.3B3, 849.1D2, 849.2D7, 849.2F12, 849.4B2, 849.4F12, 849.4F2, 849.5C2, 849.8D12, F847C.21H6, 849.5H1, 847.23F11, 847.16D10, 847.13E2-mH0mL1, 847.13E2-mH0mL2, 847.12C4, 847.4D3, or 2D10-VH0-VL0.

In some embodiments, antibodies or binding fragments thereof are provided. In some embodiments, the antibodies or binding fragments thereof are anti-Gal3 antibodies or binding fragments thereof. In some embodiments, the anti-Gal3 antibodies or binding fragments thereof comprise a light chain variable region comprising a V$_L$-CDR1, a V$_L$-CDR2, and a V$_L$-CDR3. In some embodiments, the anti- Gal3 antibodies or binding fragments thereof comprises a heavy chain variable region comprising a $V_H$-CDR1, a $V_H$-CDR2, and a $V_H$-CDR3. In some embodiments, the $V_L$-CDR1 comprises an amino acid sequence having at least 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or 100% sequence identity to SEQ ID NO: 170. In some embodiments, the $V_L$-CDR2 comprises an amino acid sequence having at least 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or 100% sequence identity to SEQ ID NO: 221. In some embodiments, the $V_L$-CDR3 comprises an amino acid sequence having at least 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or 100% sequence identity to SEQ ID NO: 248. In some embodiments, the $V_H$-CDR1 comprises an amino acid sequence having at least 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or 100% sequence identity to SEQ ID NO: 27. In some embodiments, the $V_H$-CDR2 comprises an amino acid sequence having at least 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or 100% sequence identity to SEQ ID NO: 71. In some embodiments, the $V_H$-CDR3 comprises an amino acid sequence having at least 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or 100% sequence identity to SEQ ID NO: 112.

In some embodiments, antibodies or binding fragments thereof are provided. In some embodiments, the antibodies or binding fragments thereof are anti-Gal3 antibodies or binding fragments thereof. In some embodiments, the anti-Gal3 antibodies or binding fragments thereof comprise a light chain variable region comprising a $V_L$-CDR1, a $V_L$-CDR2, and a $V_L$-CDR3. In some embodiments, the anti-Gal3 antibodies or binding fragments thereof comprises a heavy chain variable region comprising a $V_H$-CDR1, a $V_H$-CDR2, and a $V_H$-CDR3. In some embodiments, the $V_L$-CDR1 comprises an amino acid sequence having at least 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or 100% sequence similarity to SEQ ID NO: 170. In some embodiments, the $V_L$-CDR2 comprises an amino acid sequence having at least 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or 100% sequence similarity to SEQ ID NO: 221. In some embodiments, the $V_L$-CDR3 comprises an amino acid sequence having at least 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or 100% sequence similarity to SEQ ID NO: 248. In some embodiments, the $V_H$-CDR1 comprises an amino acid sequence having at least 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or 100% sequence similarity to SEQ ID NO: 27. In some embodiments, the $V_H$-CDR2 comprises an amino acid sequence having at least 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or 100% sequence similarity to SEQ ID NO: 71. In some embodiments, the $V_H$-CDR3 comprises an amino acid sequence having at least 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or 100% sequence similarity to SEQ ID NO: 112.

In some embodiments, antibodies or binding fragments thereof are provided. In some embodiments, the antibodies or binding fragments thereof are anti-Gal3 antibodies or binding fragments thereof. In some embodiments, the anti-Gal3 antibodies or binding fragments thereof comprise a light chain variable region comprising a $V_L$-CDR1, a $V_L$-CDR2, and a $V_L$-CDR3. In some embodiments, the anti-Gal3 antibodies or binding fragments thereof comprises a heavy chain variable region comprising a $V_H$-CDR1, a $V_H$-CDR2, and a $V_H$-CDR3. In some embodiments, the $V_L$-CDR1 comprises an amino acid sequence having at least 0, 1, 2, 3, 4, 5, or 6 substitutions relative to SEQ ID NO: 170. In some embodiments, the $V_L$-CDR2 comprises an amino acid sequence having at least 0, 1, 2, 3, 4, 5, or 6 substitutions relative to SEQ ID NO: 221. In some embodiments, the $V_L$-CDR3 comprises an amino acid sequence having at least 0, 1, 2, 3, 4, 5, or 6 substitutions relative to SEQ ID NO: 248. In some embodiments, the $V_H$-CDR1 comprises an amino acid sequence having at least 0, 1, 2, 3, 4, 5, or 6 substitutions relative to SEQ ID NO: 27. In some embodiments, the $V_H$-CDR2 comprises an amino acid sequence having at least 0, 1, 2, 3, 4, 5, or 6 substitutions relative to SEQ ID NO: 71. In some embodiments, the VH-CDR3 comprises an amino acid sequence having at least 0, 1, 2, 3, 4, 5, or 6 substitutions relative to SEQ ID NO: 112.

In some embodiments, the light chain variable region of the anti-Gal3 antibody or binding fragment thereof comprises a sequence having at least 80%, 81%, 82%, 83%, 84%, 85%, 86%, 87%, 88%, 89%, 90%, 91%, 92%, 93%, 94%, 95%, 96%, 97%, 98%, or 99% identity to SEQ ID NO: 374. In some embodiments, the light chain variable region of the anti-Gal3 antibody or binding fragment thereof comprises the sequence of SEQ ID NO: 374. In some embodiments, the heavy chain variable region of the anti-Gal3 antibody or binding fragment thereof comprises a sequence having at least 80%, 81%, 82%, 83%, 84%, 85%, 86%, 87%, 88%, 89%, 90%, 91%, 92%, 93%, 94%, 95%, 96%, 97%, 98%, or 99% identity to SEQ ID NO: 297. In some embodiments, the heavy chain variable region of the anti-Gal3 antibody or binding fragment thereof comprises the sequence of SEQ ID NO: 297.

In some embodiments, the light chain variable region of the anti-Gal3 antibody or binding fragment thereof comprises a sequence having at least 80%, 81%, 82%, 83%, 84%, 85%, 86%, 87%, 88%, 89%, 90%, 91%, 92%, 93%, 94%, 95%, 96%, 97%, 98%, or 99% similarity to SEQ ID NO: 374. In some embodiments, the light chain variable region of the anti-Gal3 antibody or binding fragment thereof comprises the sequence of SEQ ID NO: 374. In some embodiments, the heavy chain variable region of the anti-Gal3 antibody or binding fragment thereof comprises a sequence having at least 80%, 81%, 82%, 83%, 84%, 85%, 86%, 87%, 88%, 89%, 90%, 91%, 92%, 93%, 94%, 95%, 96%, 97%, 98%, or 99% similarity to the sequence of SEQ ID NO: 297. In some embodiments, the heavy chain variable region of the anti-Gal3 antibody or binding fragment thereof comprises the sequence of SEQ ID NO: 297.

In some embodiments, the anti-Gal3 antibody or binding fragment thereof comprises a light chain, wherein the light chain comprises a sequence having at least 80%, 81%, 82%, 83%, 84%, 85%, 86%, 87%, 88%, 89%, 90%, 91%, 92%, 93%, 94%, 95%, 96%, 97%, 98%, or 99% identity to the sequence of SEQ ID NO: 495. In some embodiments, the light chain comprises the sequence of SEQ ID NO: 495. In some embodiments, the anti-Gal3 antibody or binding fragment thereof comprises a heavy chain, wherein the heavy chain comprises a sequence having at least 80%, 81%, 82%, 83%, 84%, 85%, 86%, 87%, 88%, 89%, 90%, 91%, 92%, 93%, 94%, 95%, 96%, 97%, 98%, or 99% identity to the sequence of SEQ ID NO: 448. In some embodiments, the heavy chain comprises the sequence of SEQ ID NO: 448.

In some embodiments, the anti-Gal3 antibody or binding fragment thereof comprises a light chain, wherein the light chain comprises a sequence having at least 80%, 81%, 82%, 83%, 84%, 85%, 86%, 87%, 88%, 89%, 90%, 91%, 92%, 93%, 94%, 95%, 96%, 97%, 98%, or 99% similarity to the sequence of SEQ ID NO: 495. In some embodiments, the light chain comprises the sequence of SEQ ID NO: 495. In some embodiments, the anti-Gal3 antibody or binding fragment thereof comprises a heavy chain, wherein the heavy chain comprises a sequence having at least 80%, 81%, 82%, 83%, 84%, 85%, 86%, 87%, 88%, 89%, 90%, 91%, 92%, 93%, 94%, 95%, 96%, 97%, 98%, or 99% similarity to the sequence of SEQ ID NO: 448. In some embodiments, the heavy chain comprises the sequence of SEQ ID NO: 448.

In some embodiments, the anti-Gal3 antibody or binding fragment thereof binds to specific epitopes within a Gal3 protein. In some embodiments, the anti-Gal3 antibody or binding fragment thereof binds to a specific epitope within a Gal3 protein having an amino acid sequence according to SEQ ID NO: 1-2, provided in FIG. 6.

In some embodiments, the anti-Gal3 antibody or binding fragment thereof may bind to at least 1, 2, 3, 4, 5, 6, 7, 8, 9, 10, 11, 12, 13, 14, 15, 16, 17, 18, 19, or 20 amino acid residues within a peptide illustrated in FIG. 7 (SEQ ID NOs: 3-26).

In some embodiments, the anti-Gal3 antibody or binding fragment thereof may bind to at least 1, 2, 3, 4, 5, 6, 7, 8, 9, 10, 11, 12, 13, 14, 15, 16, 17, 18, 19, or 20 amino acid residues within amino acid residues 1-20 of SEQ ID NO: 1-2. In some embodiments, the anti-Gal3 antibody or binding fragment thereof may bind to at least 1, 2, 3, 4, 5, 6, 7, 8, 9, 10, 11, 12, 13, 14, 15, 16, 17, 18, 19, or 20 amino acid residues within amino acid residues 31-50 of SEQ ID NO: 1-2. In some embodiments, the anti-Gal3 antibody or binding fragment thereof may bind to at least 1, 2, 3, 4, 5, 6, 7, 8, 9, 10, 11, 12, 13, 14, 15, 16, 17, 18, 19, or 20 amino acid residues within amino acid residues 51-70 of SEQ ID NO: 1-2. In some embodiments, the anti-Gal3 antibody or binding fragment thereof may bind to at least 1, 2, 3, 4, 5, 6, 7, 8, 9, 10, 11, 12, 13, 14, 15, 16, 17, 18, 19, or 20 amino acid residues within amino acid residues 61-80 of SEQ ID NO: 1-2.

In some embodiments, the anti-Gal3 antibody or binding fragment thereof may bind to at least 1, 2, 3, 4, 5, 6, 7, 8, 9, 10, 11, 12, 13, 14, 15, 16, 17, 18, 19, or 20 amino acid residues within Peptide 1 (SEQ ID NO: 3), Peptide 4 (SEQ ID NO: 6), Peptide 6 (SEQ ID NO: 8), or Peptide 7 (SEQ ID NO: 9). In some embodiments, the anti-Gal3 antibody or binding fragment thereof may bind to at least 1, 2, 3, 4, 5, 6, 7, 8, 9, 10, 11, 12, 13, 14, 15, 16, 17, 18, 19, or 20 amino acid residues within Peptide 1 (SEQ ID NO: 3). In some embodiments, the anti-Gal3 antibody or binding fragment thereof may bind to at least 11, 2, 3, 4, 5, 6, 7, 8, 9, 10, 11, 12, 13, 14, 15, 16, 17, 18, 19, or 20 amino acid residues within Peptide 4 (SEQ ID NO: 6). In some embodiments, the anti-Gal3 antibody or binding fragment thereof may bind to at least 1, 2, 3, 4, 5, 6, 7, 8, 9, 10, 11, 12, 13, 14, 15, 16, 17, 18, 19, or 20 amino acid residues within Peptide 6 (SEQ ID NO: 8). In some embodiments, the anti-Gal3 antibody or binding fragment thereof may bind to at least 1, 2, 3, 4, 5, 6, 7, 8, 9, 10, 11, 12, 13, 14, 15, 16, 17, 18, 19, or 20 amino acid residues within Peptide 7 (SEQ ID NO: 9). In some embodiments, the anti-Gal3 antibody or binding fragment thereof binds to an epitope present within a region of Gal3 defined by Peptide 1 (SEQ ID NO: 3). In some embodiments, the anti-Gal3 antibody or binding fragment thereof binds to an epitope present within a region of Gal3 defined by Peptide 4 (SEQ ID NO: 6). In some embodiments, the anti-Gal3 antibody or binding fragment thereof binds to an epitope present within a region of Gal3 defined by Peptide 6 (SEQ ID NO: 8). In some embodiments, the anti-Gal3 antibody or binding fragment thereof binds to an epitope present within a region of Gal3 defined by Peptide 7 (SEQ ID NO: 9). In some embodiments, the antibody is one that binds to 1, 2, or all 3 of peptides 1, 6, and/or 7.

In some embodiments, an anti-Gal3 antibody or binding fragment thereof as described herein may bind to the N-terminal domain of Gal3 or a portion thereof. In some embodiments, an anti-Gal3 antibody or binding fragment thereof as described herein may bind to an epitope of Gal3 that includes a motif of GxYPG (SEQ ID NO: 840), where x is the amino acids alanine (A), glycine (G), or valine (V). In some embodiments, an anti-Gal3 antibody or binding fragment thereof as described herein may bind to an epitope of Gal3 that includes two GxYPG (SEQ ID NO: 840) motifs separated by three amino acids, where x is A, G, or V.

In some embodiments, the anti-Gal3 antibody or binding fragment thereof binds to Gal3. In some embodiments, the anti-Gal3 antibody or binding fragment thereof binds to the N-terminus of Gal3, the N-terminal domain of Gal3, or the TRD of Gal3. In some embodiments, the anti-Gal3 antibody or binding fragment thereof does not bind to the N-terminus of Gal3, the N-terminal domain of Gal3, or the TRD of Gal3. In some embodiments, the anti-Gal3 antibody or binding fragment thereof binds to the C-terminus of Gal3, the C-terminal domain of Gal3, or the CRD of Gal3. In some embodiments, the anti-Gal3 antibody or binding fragment thereof does not bind to the C-terminus of Gal3, the C-terminal domain of Gal3, or the CRD of Gal3. In some embodiments, the anti-Gal3 antibody or binding fragment thereof binds to Gal3 isoform 1. In some embodiments, the anti-Gal3 antibody or binding fragment thereof binds to the N-terminus of Gal3 isoform 1, the N-terminal domain of Gal3 isoform 1, amino acids 1-111 of Gal3 isoform 1, the TRD of Gal3 isoform 1, or amino acids 36-109 of Gal3 isoform 1. In some embodiments, the anti-Gal3 antibody or binding fragment thereof does not bind to the N-terminus of Gal3 isoform 1, the N-terminal domain of Gal3 isoform 1, amino acids 1-111 of Gal3, the TRD of Gal3 isoform 1, or amino acids 36-109 of Gal3 isoform 1. In some embodiments, the anti-Gal3 antibody or binding fragment thereof binds to the C-terminus of Gal3 isoform 1, the C-terminal domain of Gal3 isoform 1, amino acids 112-250 of Gal3, or the CRD of Gal3. In some embodiments, the anti-Gal3 antibody or binding fragment thereof does not bind to the C-terminus of Gal3 isoform 1, the C-terminal domain of Gal3 isoform 1, amino acids 112-250 of Gal3 isoform 1, or the CRD of Gal3. In some embodiments, the anti-Gal3 antibody or binding fragment thereof binds to the N-terminus of Gal3 isoform 3, the N-terminal domain of Gal3 isoform 3, amino acids 1-125 of Gal3, the TRD of Gal3 isoform 3, or amino acids 50-123 of Gal3 isoform 3. In some embodiments, the anti-Gal3 antibody or binding fragment thereof does not bind to the N-terminus of Gal3 isoform 3, the N-terminal domain of Gal3 isoform 3, amino acids 1-125 of Gal3 isoform 3, the TRD of Gal3, or amino acids 50-123 of Gal3 isoform 3. In some embodiments, the anti-Gal3 antibody or binding fragment thereof binds to the C-terminus of Gal3 isoform 3, the C-terminal domain of Gal3 isoform 3, amino acids 126-264 of Gal3 isoform 3, or the CRD of Gal3. In some embodiments, the anti-Gal3 antibody or binding fragment thereof does not bind to the C-terminus of Gal3 isoform 3, the C-terminal domain of Gal3 isoform 3, amino acids 126-264 of Gal3 isoform 3, or the CRD of Gal3 isoform 3.

In some embodiments, the interaction between Gal3 and a cell surface marker can be reduced to less than 80%, less than 75%, less than 70%, less than 60%, less than 59%, less than 50%, less than 40%, less than 34%, less than 30%, less than 20%, less than 14%, less than 10%, less than 7%, less than 5%, less than 4%, or less than 1%.

In some embodiments, the interaction between Gal3 and the viral protein (e.g. SARS-CoV-2 S, E, M, or HE protein) can be reduced to less than 80%, less than 75%, less than 70%, less than 60%, less than 59%, less than 50%, less than 40%, less than 34%, less than 30%, less than 20%, less than 14%, less than 10%, less than 7%, less than 5%, less than 4%, or less than 1%. In some embodiments, the interaction between Gal3 and the host receptor protein (e.g. ACE2 or CD147) can be reduced to less than 80%, less than 75%, less than 70%, less than 60%, less than 59%, less than 50%, less than 40%, less than 34%, less than 30%, less than 20%, less than 14%, less than 10%, less than 7%, less than 5%, less than 4%, or less than 1%.

In some embodiments, the anti-Gal3 antibody or binding fragment thereof binds to Gal3 with a dissociation constant ($K_D$) of less than 1 nM, less than 1.2 nM, less than 2 nM, less than 5 nM, less than 10 nM, less than 13.5 nM, less than 15 nM, less than 20 nM, less than 25 nM, or less than 30 nM. In some embodiments, the anti-Gal3 antibody or binding fragment thereof binds to Gal3 with a $K_D$ of less than 1 nM. In some embodiments, the anti-Gal3 antibody or binding fragment thereof binds to Gal3 with a $K_D$ of less than 1.2 nM. In some embodiments, the anti-Gal3 antibody or binding fragment thereof binds to Gal3 with a $K_D$ of less than 2 nM. In some embodiments, the anti-Gal3 antibody or binding fragment thereof binds to Gal3 with a $K_D$ of less than 5 nM. In some embodiments, the anti-Gal3 antibody or binding fragment thereof binds to Gal3 with a $K_D$ of less than 10 nM. In some embodiments, the anti-Gal3 antibody or binding fragment thereof binds to Gal3 with a $K_D$ of less than 13.5 nM. In some embodiments, the anti-Gal3 antibody or binding fragment thereof binds to Gal3 with a $K_D$ of less than 15 nM. In some embodiments, the anti-Gal3 antibody or binding fragment thereof binds to Gal3 with a $K_D$ of less than 20 nM. In some embodiments, the anti-Gal3 antibody or binding fragment thereof binds to Gal3 with a $K_D$ of less than 25 nM. In some embodiments, the anti-Gal3 antibody or binding fragment thereof binds to Gal3 with a $K_D$ of less than 30 nM.

In some embodiments, the anti-Gal3 antibody or binding fragment thereof comprises any one of the variable heavy chain complementarity-determining region 1 ($V_H$-CDR1) sequences illustrated in FIG. 8 (SEQ ID NOs: 27-70). In some embodiments, the anti-Gal3 antibody comprises a $V_H$-CDR1 sequence having at least 60%, at least 65%, at least 70%, at least 75%, at least 80%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% sequence identity to any one of SEQ ID NOs: 27-70. In some embodiments, the anti-Gal3 antibody comprises a $V_H$-CDR1 sequence having at least 60%, at least 65%, at least 70%, at least 75%, at least 80%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% sequence similarity to any one of SEQ ID NOs: 27-70.

In some embodiments, the anti-Gal3 antibody or binding fragment thereof comprises any one of the variable heavy chain complementarity-determining region 2 ($V_H$-CDR2) sequences illustrated in FIG. 9 (SEQ ID NOs: 71-111, 826). In some embodiments, the anti-Gal3 antibody or binding fragment thereof comprises a $V_H$-CDR2 sequence having at least 60%, at least 65%, at least 70%, at least 75%, at least 80%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% sequence identity to any one of SEQ ID NOs: 71-111, 826. In some embodiments, the anti-Gal3 antibody or binding fragment thereof comprises a $V_H$-CDR2 sequence having at least 60%, at least 65%, at least 70%, at least 75%, at least 80%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% sequence similarity to any one of SEQ ID NOs: 71-111, 826.

In some embodiments, the anti-Gal3 antibody or binding fragment thereof comprises any one of the variable heavy chain complementarity-determining region 3 ($V_H$-CDR3) sequences illustrated in FIG. 10 (SEQ ID NOs: 112-169, 827). In some embodiments, the anti-Gal3 antibody or binding fragment thereof comprises a $V_H$-CDR3 sequence having at least 60%, at least 65%, at least 70%, at least 75%, at least 80%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% sequence identity to any one of SEQ ID NOs: 112-169, 827. In some embodiments, the anti-Gal3 antibody or binding fragment thereof comprises a $V_H$-CDR3 sequence having at least 60%, at least 65%, at least 70%, at least 75%, at least 80%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% sequence similarity to any one of SEQ ID NOs: 112-169, 827.

In some embodiments, the anti-Gal3 antibody or binding fragment thereof comprises any one of the variable light chain complementarity-determining region 1 ($V_L$-CDR1)

sequences illustrated in FIG. 11 (SEQ ID NOs: 170-220). In some embodiments, the anti-Gal3 antibody or binding fragment thereof comprises a $V_L$-CDR1 sequence having at least 60%, at least 65%, at least 70%, at least 75%, at least 80%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% sequence identity to any one of SEQ ID NOs: 170-220. In some embodiments, the anti-Gal3 antibody or binding fragment thereof comprises a $V_L$-CDR1 sequence having at least 60%, at least 65%, at least 70%, at least 75%, at least 80%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% sequence similarity to any one of SEQ ID NOs: 170-220.

In some embodiments, the anti-Gal3 antibody or binding fragment thereof comprises any one of the variable light chain complementarity-determining region 2 ($V_L$-CDR2) sequences illustrated in FIG. 12 (SEQ ID NOs: 221-247). In some embodiments, the anti-Gal3 antibody or binding fragment thereof comprises a $V_L$-CDR2 sequence having at least 60%, at least 65%, at least 70%, at least 75%, at least 80%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% sequence identity to any one of SEQ ID NOs: 221-247. In some embodiments, the anti-Gal3 antibody or binding fragment thereof comprises a $V_L$-CDR2 sequence having at least 60%, at least 65%, at least 70%, at least 75%, at least 80%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% sequence similarity to any one of SEQ ID NOs: 221-247.

In some embodiments, the anti-Gal3 antibody or binding fragment thereof comprises any one of the variable light chain complementarity-determining region 3 ($V_L$-CDR3) sequences illustrated in FIG. 13 (SEQ ID NOs: 248-296). In some embodiments, the anti-Gal3 antibody or binding fragment thereof comprises a $V_L$-CDR3 sequence having at least 60%, at least 65%, at least 70%, at least 75%, at least 80%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% sequence identity to any one of SEQ ID NOs: 248-296. In some embodiments, the anti-Gal3 antibody or binding fragment thereof comprises a $V_L$-CDR3 sequence having at least 60%, at least 65%, at least 70%, at least 75%, at least 80%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% sequence similarity to any one of SEQ ID NOs: 248-296.

In some embodiments, the anti-Gal3 antibody or binding fragment thereof comprises a heavy chain variable region ($V_H$) and a light chain variable region ($V_L$). In some embodiments, the $V_H$ may comprise a $V_H$-CDR1, a $V_H$-CDR2, and/or a $V_H$-CDR3 selected from any of FIG. 8-10. In some embodiments, the $V_L$ may comprise a $V_L$-CDR1, a $V_L$-CDR2, and/or a $V_L$-CDR3 selected from any of FIG. 11-13. In some embodiments, the anti-Gal3 antibody or binding fragment thereof comprises CDRs within the $V_H$ and $V_L$ sequences as illustrated in FIG. 14. It is understood that an antibody with an antibody name described herein can be referred using a shortened version of the antibody name, as long as there are no conflicts with another antibody described herein. For example, F846C.1B2 can also be referred to as 846C.1B2, or 846.1B2.

In some embodiments, the anti-Gal3 antibody or binding fragment thereof comprises a heavy chain variable region ($V_H$) sequence selected from FIG. 15 (SEQ ID NOs: 297-373, 822, 828). In some embodiments, the anti-Gal3 antibody or binding fragment thereof comprises a $V_H$-sequence having at least 60%, at least 65%, at least 70%, at least 75%, at least 80%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% sequence identity to any one of SEQ ID NOs: 297-373, 822, 828. In some embodiments, the anti-Gal3 antibody or binding fragment thereof comprises a $V_H$-sequence having at least 60%, at least 65%, at least 70%, at least 75%, at least 80%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% sequence similarity to any one of SEQ ID NOs: 297-373, 822, 828.

In some embodiments, the anti-Gal3 antibody or binding fragment thereof comprises a light chain variable region ($V_L$) sequence selected from FIG. 16 (SEQ ID NOs: 374-447, 823-825). In some embodiments, the anti-Gal3 antibody or binding fragment thereof comprises a $V_L$ sequence having at least 60%, at least 65%, at least 70%, at least 75%, at least 80%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% sequence identity to any one of SEQ ID NOs: 374-447, 823-825. In some embodiments, the anti-Gal3 antibody or binding fragment thereof comprises a $V_L$ sequence having at least 60%, at least 65%, at least 70%, at least 75%, at least 80%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% sequence similarity to any one of SEQ ID NOs: 374-447, 823-825.

In some embodiments, the anti-Gal3 antibody or binding fragment thereof comprises a combination of heavy chain variable region and light chain variable region as illustrated in FIG. 17.

In some embodiments, the anti-Gal3 antibody or binding fragment thereof comprises heavy chain and light chain sequences as illustrated in FIG. 18 (SEQ ID NOs: 448-538, 830.

In some embodiments, the anti-Gal3 antibody or binding fragment thereof is selected from the group of: TB001, TB006, 12G5.D7, 13A12.2E5, 14H10.2C9, 15F10.2D6, 19B5.2E6, 20D11.2C6, 20H5.A3, 23H9.2E4, 2D10.2B2, 3B11.2G2, 7D8.2D8, mIMT001, 4A11.2B5, 4A11.H1L1, 4A11.H4L2, 4G2.2G6, 6B3.2D3, 6H6.2D6, 9H2.2H10, 13G4.2F8, 13H12.2F8, 15G7.2A7, 19D9.2E5, 23B10.2B12, 24D12.2H9, F846C.1B2, F846C.1F5, F846C.1H12, F846C.1H5, F846C.2H3, F846TC.14A2, F846TC.14E4, F846TC.16B5, F846TC.7F10, F847C.10B9, F847C.11B1, F847C.12F12, F847C.26F5, F847C.4B10, F849C.8D10, F849C.8H3, 846.2B11, 846.4D5, 846T.1H2, 847.14H4, 846.2D4, 846.2F11, 846T.10B1, 846T.2E3, 846T.4C9, 846T.4E11, 846T.4F5, 846T.8D1, 847.10C9, 847.11D6, 847.15D12, 847.15F9, 847.15H11, 847.20H7, 847.21B11, 847.27B9, 847.28D1, 847.2B8, 847.3B3, 849.1D2, 849.2D7, 849.2F12, 849.4B2, 849.4F12, 849.4F2, 849.5C2, 849.8D12, F847C.21H6, 849.5H1, 847.23F11, 847.16D10, 847.13E2-mH0mL1, 847.13E2-mH0mL2, 847.12C4, 847.4D3, 2D10-VH0-VL0, or a binding fragment thereof.

In some embodiments, the anti-Gal3 antibody or binding fragment thereof comprises, consists essentially of, or consists of TB001, TB006, 12G5.D7, 13A12.2E5, 14H10.2C9, 15F10.2D6, 19B5.2E6, 20D11.2C6, 20H5.A3, 23H9.2E4, 2D10.2B2, 3B11.2G2, 7D8.2D8, mIMT001, 4A11.2B5, 4A11.H1L1, 4A11.H4L2, 4G2.2G6, 6B3.2D3, 6H6.2D6, 9H2.2H10, 13G4.2F8, 13H12.2F8, 15G7.2A7, 19D9.2E5, 23B10.2B12, 24D12.2H9, F846C.1B2, F846C.1F5, F846C.1H12, F846C.1H5, F846C.2H3, F846TC.14A2, F846TC.14E4, F846TC.16B5, F846TC.7F10, F847C.10B9, F847C.11B1, F847C.12F12, F847C.26F5, F847C.4B10, F849C.8D10, F849C.8H3, 846.2B11, 846.4D5, 846T.1H2, 847.14H4, 846.2D4, 846.2F11, 846T.10B1, 846T.2E3, 846T.4C9, 846T.4E11, 846T.4F5, 846T.8D1, 847.10C9, 847.11D6, 847.15D12, 847.15F9, 847.15H11, 847.20H7, 847.21B11, 847.27B9, 847.28D1, 847.2B8, 847.3B3, 849.1D2, 849.2D7, 849.2F12, 849.4B2, 849.4F12, 849.4F2, 849.5C2, 849.8D12, F847C.21H6, 849.5H1, 847.23F11, 847.16D10, 847.13E2-mH0mL1, 847.13E2-mH0mL2, 847.12C4, 847.4D3, 2D10-VH0-VL0, or a binding fragment thereof.

In some embodiments, the anti-Gal3 antibody or binding fragment thereof comprises one or more heavy chain variable region CDRs depicted in FIG. 8-10. In some embodiments, the anti-Gal3 antibody or binding fragment thereof comprises one or more light chain variable region CDRs depicted in FIG. 11-13. In some embodiments, the anti-Gal3 antibody or binding fragment thereof comprises a heavy chain variable region depicted in FIG. 15. In some embodiments, the anti-Gal3 antibody or binding fragment thereof comprises a light chain variable region depicted in FIG. 16. In some embodiments, the anti-Gal3 antibody or binding fragment thereof comprises a combination of heavy chain variable region and light chain variable region depicted in FIG. 17. In some embodiments, the anti-Gal3 antibody or binding fragment thereof comprises a heavy chain and/or light chain depicted in FIG. 18. In some embodiments, the anti-Gal3 antibody or binding fragment thereof can comprise or include any one or more of the sequences provided in any one or more of FIG. 8, 9, 10, 11, 12, 13, 14, 15, 16, 17 or 18 or any one or more of a sequence that is at least 80%, 81%, 82%, 83%, 84%, 85%, 86%, 87%, 88%, 89%, 90%, 91%, 92%, 93%, 94%, 95%, 96%, 97%, 98%, 99% or greater identical thereto. In some embodiments, the anti-Gal3 antibody or binding fragment thereof can comprise or include any one or more of the sequences provided in any one or more of FIG. 8, 9, 10, 11, 12, 13, 14, 15, 16, 17 or 18 or any one or more of a sequence that is at least 80%, 81%, 82%, 83%, 84%, 85%, 86%, 87%, 88%, 89%, 90%, 91%, 92%, 93%, 94%, 95%, 96%, 97%, 98%, 99% or greater similar thereto.

In some embodiments, the anti-Gal3 antibody or binding fragment thereof comprises a humanized antibody or binding fragment thereof. In other instances, the anti-Gal3 antibody or binding fragment thereof comprises a chimeric antibody or binding fragment thereof. In some embodiments, the anti-Gal3 antibody comprises a full-length antibody or a binding fragment thereof. In some embodiments, the anti-Gal3 antibody or binding fragment thereof comprises a bispecific antibody or a binding fragment thereof. In some embodiments, the anti-Gal3 antibody or binding fragment thereof comprises a monovalent Fab', a divalent Fab2, a single-chain variable fragment (scFv), a diabody, a minibody, a nanobody, a single-domain antibody (sdAb), or a camelid antibody or binding fragment thereof.

In some embodiments, the anti-Gal3 antibody or binding fragment thereof is a bispecific antibody or binding fragment thereof. Exemplary bispecific antibody formats include, but are not limited to, Knobs-into-Holes (KiH), Asymmetric Re-engineering Technology-immunoglobulin (ART-Ig), Triomab quadroma, bispecific monoclonal antibody (BiMAb, BsmAb, BsAb, bsMab, BS-Mab, or Bi-MAb), Azymetric, Biclonics, Fab-scFv-Fc, Two-in-one/Dual Action Fab (DAF), FinomAb, scFv-Fc-(Fab)-fusion, Dock-aNd-Lock (DNL), Tandem diAbody (TandAb), Dual-affinity-ReTargeting (DART), nanobody, triplebody, tandems scFv (taFv), triple heads, tandem dAb/VHH, triple dAb/VHH, or tetravalent dAb/VHH. In some embodiments, the anti-Gal3 antibody or binding fragment thereof is a bispecific antibody or binding fragment thereof comprising a bispecific antibody format illustrated in FIG. 2 of Brinkmann and Kontermann, "The making of bispecific antibodies," *MABS* 9(2): 182-212 (2017).

In some embodiments, the anti-Gal3 antibody or binding fragment thereof can comprise an IgM, IgG (e.g., IgG1, IgG2, IgG3, or IgG4), IgA, or IgE framework. The IgG framework can be IgG1, IgG2, IgG3 or IgG4. In some embodiments, the anti-Gal3 antibody or binding fragment thereof comprises an IgG1 framework. In some embodiments, the anti-Gal3 antibody or binding fragment thereof comprises an IgG2 framework. In some embodiments, the anti-Gal3 antibody or binding fragment thereof comprises an IgG4 framework. The anti-Gal3 antibody or binding fragment thereof can further comprise a Fc mutation.

Figure 19:
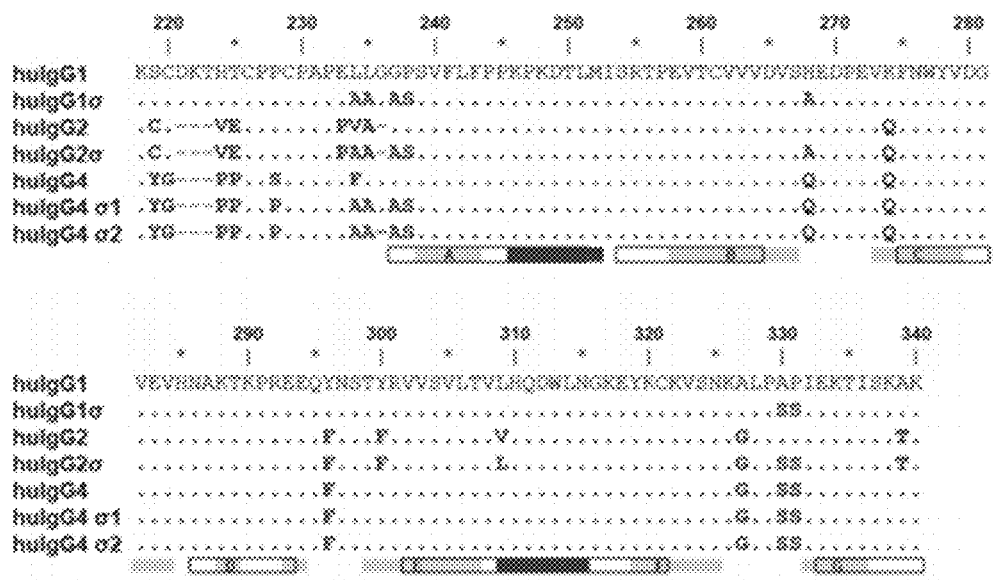
FIG. 19 depicts an alignment of hinge and constant heavy chain domain 2 ($C_H2$) domain amino acid sequences of wild-type human immunoglobulin G1 (IgG1), IgG2 and IgG4 as well as their sigma variants. The alignment above uses EU numbering. Residues identical to wild-type IgG1 are indicated as dots; gaps are indicated with hyphens. Sequence is given explicitly if it differs from wild-type IgG1 or from the parental subtype for a variants. Open boxes beneath the alignment correspond to International Immunogenetics Information System (IMGT) strand definitions. Boxes beneath the alignment correspond to the strand and helix secondary structure assignment for wild-type IgG1. Residues 267-273 form the BC loop and 322-332 form the FG loop. Also provided are exemplary constant regions for human IgG4 heavy (S228P mutant) and light (kappa) chains (SEQ ID NOs: 832-833) and murine IgG2A (LALAPG and LALA mutants) (SEQ ID NOs: 838-839). In some embodiments, any one or more of the VH/VL and/or CDRs provided in the other figures or otherwise disclosed herein can be paired with any one or more of the exemplary constant regions provided herein.

In some embodiments, the Fc region comprises one or more mutations that modulate Fc receptor interactions, e.g., to enhance effector functions such as ADCC and/or CDC. In such instances, exemplary residues when mutated modulate effector functions include S239, K326, A330, I332, or E333, in which the residue position correspond to IgG1 and the residue numbering is in accordance to Kabat numbering (EU index of Kabat et al 1991 Sequences of Proteins of Immunological Interest) (FIG. 19). In some embodiments, the one or more mutations comprise S239D, K326W, A330L, I332E, E333A, E333S, or a combination thereof. In some embodiments, the one or more mutations comprise S239D, I332E, or a combination thereof. In some embodiments, the one or more mutations comprise S239D, A330L, I332E, or a combination thereof. In some embodiments, the one or more mutations comprise K326W, E333S, or a combination thereof. In some embodiments, the mutation comprises E333A.

In some embodiments, an anti-Gal3 antibody or binding fragment thereof comprises a humanization score of above 70, above 80, above 81, above 82, above 83, above 84, above 85, above 86, above 87, above 88, above 89, above 90, or above 95. In some embodiments, the anti-Gal3 antibody or binding fragment thereof comprises a humanization score of above 80. In some embodiments, the anti-Gal3 antibody or binding fragment thereof comprises a humanization score of above 83. In some embodiments, the anti-Gal3 antibody or binding fragment thereof comprises a humanization score of above 85. In some embodiments, the anti-Gal3 antibody or binding fragment thereof comprises a humanization score of above 87. In some embodiments, the anti-Gal3 antibody or binding fragment thereof comprises a humanization score of above 90. In some embodiments, the anti-Gal3 antibody or binding fragment thereof comprises a humanization score of the heavy chain of above 70, above 80, above 81, above 82, above 83, above 84, above 85, above 86, above 87, above 88, above 89, above 90, or above 95, optionally above 80, above 85, or above 87. In some embodiments, the anti-Gal3 antibody or binding fragment thereof comprises a humanization score of the light chain of above 70, above 80, above 81, above 82, above 83, above 84, above 85, above 86, above 87, above 88, above 89, above 90, or above 95, optionally above 80, above 83, or above 85.

Also disclosed herein are proteins. In some embodiments, the proteins comprise one or more of SEQ ID NOs: 170-533. In some embodiments, the proteins comprise a sequence having at least 80%, 81%, 82%, 83%, 84%, 85%, 86%, 87%, 88%, 89%, 90%, 91%, 92%, 93%, 94%, 95%, 96%, 97%, 98%, 99%, or 100% identity to one or more of SEQ ID NOs: 170-533. In some embodiments, the proteins comprise a sequence having at least 0, 1, 2, 3, 4, 5, or 6 substitutions relative to any one or more sequences of SEQ ID NOs: 170-533. In some embodiments, the proteins comprise six sequences selected from each of SEQ ID NOs: 170-220; SEQ ID NOs: 221-247; SEQ ID NOs: 248-296; SEQ ID NOs: 27-70; SEQ ID NOs: 71-111, 826; and SEQ ID NOs: 112-169, 827. In some embodiments, the proteins comprise two sequences selected from each of SEQ ID NOs: 374-447, 823-825 and SEQ ID NOs: 297-373, 822, 828. In some embodiments, the proteins comprise two sequences selected from each of SEQ ID NOs: 495-538, 830 and SEQ ID NOs: 448-494, 829. In some embodiments, the proteins comprise any one or more sequences selected from the groups of SEQ ID NOs: 170-220; SEQ ID NOs: 221-247; SEQ ID NOs: 248-296; SEQ ID NOs: 27-70; SEQ ID NOs: 71-111, 826; SEQ ID NOs: 112-169, 827; SEQ ID NOs: 374-447, 823-825; SEQ ID NOs: 297-373,822,828; SEQ ID NOs: 495-538, 830; SEQ ID NOs: 448-494, 829. In some embodiments, the proteins comprise any one or more of the sequences depicted in FIGS. 8-18.

In some embodiments, the protein comprises one or more sequences defined by a consensus sequence. The consensus sequences provided herein have been derived from the alignments of CDRs depicted in FIG. 33A-B. However, it is envisioned that alternative alignments may be done (e.g. using global or local alignment, or with different algorithms, such as Hidden Markov Models, seeded guide trees, Needleman-Wunsch algorithm, or Smith-Waterman algorithm) and as such, alternative consensus sequences can be derived.

In some embodiments, the protein comprises a sequence defined by the formula $X_1X_2X_3X_4X_5X_6X_7X_8X_9X_{10}X_{11}X_{12}X_{13}X_{14}X_{15}X_{16}X_{17}$, where $X_1$ is no amino acid or R; $X_2$ is no amino acid or S; $X_3$ is no amino acid, S, or T; $X_4$ is no amino acid, E, G, K, Q, or R; $X_5$ is no amino acid, A, D, G, I, N, or S; $X_6$ is no amino acid, I, L, or V; $X_7$ is no amino acid, F, L, S, or V; $X_8$ is no amino acid, D, E, H, N, S, T, or Y; $X_9$ is no amino acid, D, E, I, K, N, R, S, T, or V; $X_{10}$ is no amino acid, D, H, N, R, S, or Y; $X_{11}$ is no amino acid, A, G, N, S, T, or V; $X_{12}$ is no amino acid, A, I, K, N, Q, T, V, or Y; $X_{13}$ is no amino acid, D, G, H, K, N, S, T, or Y; $X_{14}$ is no amino acid, C, F, I, N, S, T, V, or Y; $X_{15}$ is no amino acid, D, L, N, W, or Y; $X_{16}$ is no amino acid, N, or D; $X_{17}$ is no amino acid or D. In some embodiments, the protein comprises a sequence having at least 80%, 81%, 82%, 83%, 84%, 85%, 86%, 87%, 88%, 89%, 90%, 91%, 92%, 93%, 94%, 95%, 96%, 97%, 98%, 99%, or 100% identity to this consensus sequence. In some embodiments, the protein comprises a sequence having 0, 1, 2, 3, 4, 5, or 6 substitutions from this consensus sequence.

In some embodiments, the protein comprises a sequence defined by the formula $X_1X_2X_3X_4X_5X_6X_7X_8$, where $X_1$ is no amino acid, K, L, N, Q, or R; $X_2$ is no amino acid, A, L, M, or V; $X_3$ is no amino acid, C, K, or S; $X_4$ is no amino acid or T; $X_5$ is no amino acid, A, E, F, G, H, K, Q, R, S, W, or Y; $X_6$ is no amino acid, A, G, or T; $X_7$ is no amino acid, I, K, N, S, or T; $X_8$ is no amino acid, N, or S. In some embodiments, the protein comprises a sequence having at least 80%, 81%, 82%, 83%, 84%, 85%, 86%, 87%, 88%, 89%, 90%, 91%, 92%, 93%, 94%, 95%, 96%, 97%, 98%, 99%, or 100% identity to this consensus sequence. In some embodiments, the protein comprises a sequence having 0, 1, 2, 3, 4, 5, or 6 substitutions from this consensus sequence.

In some embodiments, the protein comprises a sequence defined by the formula $X_1X_2X_3X_4X_5X_6X_7X_8X_9X_{10}$, where $X_1$ is no amino acid, A, E, F, H, L, M, Q, S, V, or W; $X_2$ is A, H, or Q; $X_3$ is D, F, G, H, L, M, N, Q, S, T, W, or Y; $X_4$ is no amino acid or W; $X_5$ is A, D, I, K, L, N, Q, R, S, T, V, or Y; $X_6$ is D, E, H, I, K, L, N, Q, S, or T; $X_7$ is D, F, K, L, N, P, S, T, V, W, or Y; $X_8$ is H, P, or S; $X_9$ is F, L, P, Q, R, T, W, or Y; $X_{10}$ is no amino acid, T, or V. In some embodiments, the protein comprises a sequence having at least 80%, 81%, 82%, 83%, 84%, 85%, 86%, 87%, 88%, 89%, 90%, 91%, 92%, 93%, 94%, 95%, 96%, 97%, 98%, 99%, or 100% identity to this consensus sequence. In some embodiments, the protein comprises a sequence having 0, 1, 2, 3, 4, 5, or 6 substitutions from this consensus sequence.

In some embodiments, the protein comprises a sequence defined by the formula $X_1X_2X_3X_4X_5X_6X_7X_8X_9X_{10}$, where $X_1$ is E, G, or R; $X_2$ is F, N, or Y; $X_3$ is A, I, K, N, S, or T; $X_4$ is F, I, or L; $X_5$ is I, K, N, R, S, or T; $X_6$ is D, G, I, N, S, or T; $X_7$ is F, G, H, S, or Y; $X_8$ is no amino acid, A, D, G, I, M, N, T, V, W, or Y; $X_9$ is no amino acid, M, or Y; $X_{10}$ is no amino acid or G; In some embodiments, the protein comprises a sequence having at least 80%, 81%, 82%, 83%, 84%, 85%, 86%, 87%, 88%, 89%, 90%, 91%, 92%, 93%, 94%, 95%, 96%, 97%, 98%, 99%, or 100% identity to this consensus sequence. In some embodiments, the protein comprises a sequence having 0, 1, 2, 3, 4, 5, or 6 substitutions from this consensus sequence.

In some embodiments, the protein comprises a sequence defined by the formula $X_1X_2X_3X_4X_5X_6X_7X_8X_9X_{10}$, where $X_1$ is no amino acid, I, or L; $X_2$ is no amino acid or R; $X_3$ is no amino acid, F, I, L, or V; $X_4$ is A, D, F, H, K, L, N, S, W, or Y; $X_5$ is A, D, P, S, T, W, or Y; $X_6$ is D, E, G, H, K, N, S, V, or Y; $X_7$ is D, E, G, N, S, or T; $X_8$ is D, G, I, K, N, Q, R, S, V, or Y; $X_9$ is A, D, E, G, I, K, N, P, S, T, V, or Y; $X_{10}$ is no amino acid, I, P, S, or T. In some embodiments, the protein comprises a sequence having at least 80%, 81%, 82%, 83%, 84%, 85%, 86%, 87%, 88%, 89%, 90%, 91%, 92%, 93%, 94%, 95%, 96%, 97%, 98%, 99%, or 100% identity to this consensus sequence. In some embodiments, the protein comprises a sequence having 0, 1, 2, 3, 4, 5, or 6 substitutions from this consensus sequence.

In some embodiments, the protein comprises a sequence defined by the formula $X_1X_2X_3X_4X_5X_6X_7X_8X_9X_{10}X_{11}X_{12}X_{13}X_{14}X_{15}X_{16}X_{17}X_{18}X_{19}X_{20}X_{21}X_{22}X_{23}X_{24}X_{25}$, where $X_1$ is no amino acid or A; $X_2$ is no amino acid, A, R, or Y; $X_3$ is no amino acid, A, F, H, K, L, R, S, or V; $X_4$ is no amino acid, A, D, K, N, R, S, or T; $X_5$ is no amino acid, A, D, G, H, I, L, N, P, R, S, T, V, or Y; $X_6$ is no amino acid, A, D, G, H, K, N, P, Q, R, S, or Y; $X_7$ is no amino acid, D, F, G, H, P, R, S, W, or Y; $X_8$ is no amino acid, A, D, E, G, I, R, or S; $X_9$ is no amino acid, A, C, D, E, F, G, I, N, R, S, T, V, or Y; $X_{10}$ is no amino acid, A, D, M, P, R, S, T, V, or Y; $X_{11}$ is no amino acid, A, D, E, F, L, T, V, or Y; $X_{12}$ is no amino acid, A, G, L, M, R, or T; $X_{13}$ is no amino acid, A, D, E, F, G, R, S, T, or V; $X_{14}$ is no amino acid, A, D, G, L, P, Q, R, S, T, V, or Y; $X_{15}$ is no amino acid, A, D, G, N, S, V, W, or Y; $X_{16}$ is no amino acid, A, D, E, F, L, P, T, V, W, or Y; $X_{17}$ is no amino acid, F, I, L, M, R, or Y; $X_{18}$ is no amino acid, A, D, G, N, or T; $X_{19}$ is no amino acid, F, N, S, T, V, or Y; $X_{20}$ is no amino acid or L; $X_{21}$ is no amino acid or A; $X_{22}$ is no amino acid or W; $X_{23}$ is no amino acid or F; $X_{24}$ is no amino acid or A; $X_{25}$ is no amino acid or Y. In some embodiments, the protein comprises a sequence having at least 80%, 81%, 82%, 83%, 84%, 85%, 86%, 87%, 88%, 89%, 90%, 91%, 92%, 93%, 94%, 95%, 96%, 97%, 98%, 99%, or 100% identity to this consensus sequence. In some embodiments, the protein comprises a sequence having 0, 1, 2, 3, 4, 5, or 6 substitutions from this consensus sequence.

Exemplary Pharmaceutical Formulations

A pharmaceutical formulation for treating a disease as described herein can comprise an anti-Gal3 antibody or binding fragment thereof described supra. The anti-Gal3 antibody or binding fragment thereof can be formulated for systemic administration. Alternatively, the anti-Gal3 antibody or binding fragment thereof can be formulated for parenteral administration.

In some embodiments, an anti-Gal3 antibody or binding fragment thereof is formulated as a pharmaceutical composition for administration to a subject by, but not limited to, parenteral (e.g., intravenous, subcutaneous, intramuscular, intraarterial, intradermal, intraperitoneal, intravitreal, intracerebral, or intracerebroventricular), oral, intranasal, buccal, rectal, or transdermal administration routes. In some embodiments, the pharmaceutical composition describe herein is formulated for parenteral (e.g., intravenous, subcutaneous, intramuscular, intraarterial, intradermal, intraperitoneal, intravitreal, intracerebral, or intracerebroventricular) administration. In other instances, the pharmaceutical composition describe herein is formulated for systemic administration. In other instances, the pharmaceutical composition describe herein is formulated for oral administration. In still other instances, the pharmaceutical composition describe herein is formulated for intranasal administration.

In some embodiments, the pharmaceutical compositions further include pH adjusting agents or buffering agents which include acids such as acetic, boric, citric, lactic, phosphoric and hydrochloric acids; bases such as sodium hydroxide, sodium phosphate, sodium borate, sodium citrate, sodium acetate, sodium lactate and tris-hydroxymethylaminomethane; and buffers such as citrate/dextrose, sodium bicarbonate and ammonium chloride. Such acids, bases and buffers are included in an amount required to maintain pH of the composition in an acceptable range.

In some embodiments, the pharmaceutical compositions include one or more salts in an amount required to bring osmolality of the composition into an acceptable range. Such salts include those having sodium, potassium or ammonium cations and chloride, citrate, ascorbate, borate, phosphate, bicarbonate, sulfate, thiosulfate or bisulfite anions; suitable salts include sodium chloride, potassium chloride, sodium thiosulfate, sodium bisulfite and ammonium sulfate.

In some embodiments, the pharmaceutical compositions further include diluent which are used to stabilize compounds because they can provide a more stable environment. Salts dissolved in buffered solutions (which also can provide pH control or maintenance) are utilized as diluents in the art, including, but not limited to a phosphate buffered saline solution. In certain instances, diluents increase bulk of the composition to facilitate compression or create sufficient bulk for homogenous blend for capsule filling. Such compounds can include e.g., lactose, starch, mannitol, sorbitol, dextrose, microcrystalline cellulose such as Avicel®; dibasic calcium phosphate, dicalcium phosphate dihydrate; tricalcium phosphate, calcium phosphate; anhydrous lactose, spray-dried lactose; pregelatinized starch, compressible sugar, such as Di-Pac® (Amstar); mannitol, hydroxypropylmethylcellulose, hydroxypropylmethylcellulose acetate stearate, sucrose-based diluents, confectioner's sugar; monobasic calcium sulfate monohydrate, calcium sulfate dihydrate; calcium lactate trihydrate, dextrates; hydrolyzed cereal solids, amylose; powdered cellulose, calcium carbonate; glycine, kaolin; mannitol, sodium chloride; inositol, bentonite, and the like.

In some embodiments, the pharmaceutical formulations include, but are not limited to, aqueous liquid dispersions, self-emulsifying dispersions, solid solutions, liposomal dispersions, aerosols, solid dosage forms, powders, immediate release formulations, controlled release formulations, fast melt formulations, tablets, capsules, pills, delayed release formulations, extended release formulations, pulsatile release formulations, multiparticulate formulations (e.g., nanoparticle formulations), and mixed immediate and controlled release formulations.

In some embodiments, the pharmaceutical formulation can further comprise an additional therapeutic agent. Non-limiting examples of additional therapeutic agents include alpha-glucosidase inhibitors, including acarbose (Precose®) and miglitol (Glyset®); biguanides, including metformin-alogliptin (Kazano®), metformin-canagliflozin (Invokamet®), metformin-dapagliflozin (Xigduo® XR), metformin-empagliflozin (Synjardy®), metformin-glipizide, metformin-glyburide (Glucovance®), metformin-linagliptin (Jentadueto®), metformin-pioglitazone (Actoplus®), metformin-repaglinide (PrandiMet®), metformin-rosiglitazone (Avandamet®), metformin-saxagliptin (Kombiglyze® XR), and metformin-sitagliptin (Janumet®); dopamine agonists, including Bromocriptine (Cycloset®); Dipeptidyl peptidase-4 (DPP-4) inhibitors, including alogliptin (Nesina®), alogliptin-metformin (Kazano®), alogliptin-pioglitazone (Oseni®), linagliptin (Tradjenta®), linagliptin-empagliflozin (Glyxambi®), linagliptin-metformin (Jentadueto®), saxagliptin (Onglyza®), saxagliptin-metformin (Kombiglyze® XR), sitagliptin (Januvia®), sitagliptin-metformin (Janumet® and Janumet® XR), and sitagliptin and simvastatin (Juvisync®); Glucagon-like peptide-1 receptor agonists (GLP-1 receptor agonists), including albiglutide (Tanzeum®), dulaglutide (Trulicity®), exenatide (Byetta®), exenatide extended-release (Bydureon®), and liraglutide (Victoza®), semaglutide (Ozempic®); Meglitinides, including nateglinide (Starlix®), repaglinide (Prandin®), and repaglinide-metformin (Prandimet®); Sodium-glucose transporter (SGLT) 2 inhibitors, including dapagliflozin (Farxiga®), dapagliflozin-metformin (Xigduo® XR), canagliflozin (Invokana®), canagliflozin-metformin (Invokamet®), empagliflozin (Jardiance®), empagliflozin-linagliptin (Glyxambi®), empagliflozin-metformin (Synjardy®), and ertugliflozin (Steglatro®); Sulfonylureas, including glimepiride (Amaryl®), glimepiride-pioglitazone (Duetact®), glimepiride-rosiglitazone (Avandaryl®), gliclazide, glipizide (Glucotrol®), glipizide-metformin (Metaglip®), glyburide (DiaBeta®, Glynase®, Micronase®), glyburide-metformin (Glucovance®), chlorpropamide (Diabinese®), tolazamide (Tolinase®), and tolbutamide (Orinase®, Tol-Tab®); Thiazolidinediones, including rosiglitazone (Avandia®), rosiglitazone-glimepiride (Avandaryl®), rosiglitazone-metformin (Amaryl M®), pioglitazone (Actos®), pioglitazone-alogliptin (Oseni®), pioglitazone-glimepiride (Duetact®), pioglitazone-metformin (Actoplus Met®, Actoplus Met® XR).

Disclosed herein are pharmaceutical antibody formulations. These pharmaceutical antibody formulations can be used for therapeutic applications. In some embodiments, the pharmaceutical antibody formulations comprise a therapeutically effective amount of an antibody, such as an anti-Gal3 antibody. In some embodiments, the antibody is any of the anti-Gal3 antibodies disclosed herein or otherwise known in the art, such as those described in WO 2020/160156. The pharmaceutical antibody formulations may also comprise one or more excipients, diluents, salts, buffers, and the like, which confer desirable properties to the formulation, such as improved stability, reduction in aggregation, and modulation of isotonicity and pH. It is envisioned that one or more excipients, diluents, salts, buffers, and the like generally known in the art can be used in the pharmaceutical antibody formulations disclosed herein and/or can be used as an acceptable substitute for any of the excipients, diluents, salts, buffers, and the like used in the pharmaceutical antibody formulations disclosed herein, and determining an optimal formulation of excipients, diluents, salts, buffers, and the like is within the ability of one skilled in the art. The inclusion of one or more excipients, diluents, salts, buffers, and the like may be adjusted for the treatment of a certain disease, such as a coronavirus infection, or inflammation associated with said disease, and/or optimized to improve the stability of the pharmaceutical antibody formulations under storage.

Disclosed in some embodiments are pharmaceutical antibody formulations comprising an antibody and one or more excipients. The one or more excipients may be used to improve stability of the anti-Gal3 antibody under storage conditions and/or improve biocompatibility when administered to a subject. The one or more excipients may comprise small molecules, amino acids, peptides, proteins, nucleic acids, DNA, RNA, lipids, ionic compounds, salts, carbohydrates, sugars, sugar alcohols, acids, bases, surfactants, detergents, or other excipients known in the art. In some embodiments, the pharmaceutical antibody formulations are at a specific pH that improves stability of the anti-Gal3 antibody under storage conditions and/or improve biocompatibility when administered to a subject. In some embodiments, the one or more excipients are used to adjust the pH to the desired level. In some embodiments, the pH of the pharmaceutical antibody formulations are adjusted after addition of the one or more excipients to the desired pH (e.g. by addition of a compatible acid or base, such as HCl, $H_2SO_4$, acetic acid, citric acid, phosphates, NaOH, KOH, etc.). The pharmaceutical antibody formulations may be acidic, basic, or neutral. In some embodiments, the antibody is an anti-Gal3 antibody.

In some embodiments of the pharmaceutical antibody formulations disclosed herein comprising an antibody and one or more excipients, the one or more excipients comprise one or more amino acids, one or more salts, one or more surfactants, or any combination thereof. In some embodiments, the one or more amino acids may comprise alanine, arginine, asparagine, aspartic acid, cysteine, glutamine, glutamic acid, glycine, histidine, isoleucine, leucine, lysine, methionine, phenylalanine, proline, serine, threonine, tryptophan, tyrosine, valine, or any combination thereof. The one or more amino acids used as excipients may be L-stereoisomers or D-stereoisomers. In some embodiments, the one or more amino acids may be in the form of small peptides, such as dipeptides, tripeptides, tetrapeptides, or more. Some embodiments of the pharmaceutical antibody formulations comprise histidine or methionine, or both. In some embodiments, the histidine or methionine, or both, are L-stereoisomers or D-stereoisomers. Other amino acids, either as substitutes of histidine or methionine, or both, or in addition to histidine or methionine, or both, are also envisioned in some embodiments, depending on the desired properties conferred to the formulations, such as improved stability, pH adjustment, and compatibility to the intended subject. Some non-limiting embodiments of pharmaceutical antibody formulations may comprise 1) histidine and methionine, 2) histidine and any one or more other amino acids, 3) methionine and any one or more other amino acids, 4) one or more amino acids other than histidine and methionine (e.g. one or more of arginine, glycine, or glutamate), or 5) histidine, methionine, and one or more other amino acids (e.g. one or more of arginine, glycine, or glutamate). In some embodiments, the antibody is an anti-Gal3 antibody.

In some embodiments of the pharmaceutical antibody formulations disclosed herein comprising an antibody and one or more excipients, including the ones comprising one or more amino acids as disclosed herein, the one or more excipients comprise one or more salts. In some embodiments, the one or more salts may comprise salts conventionally used as excipients. In some embodiments, the one or more salts may comprise chloride salts, phosphate salts, carbonate salts, bicarbonate salts, citrate salts, ascorbate salts, acetate salts, succinate salts, Tris salts, borate salts, sulfate salts, ammonia salts, metal salts, sodium salts, potassium salts, calcium salts, magnesium salts, organic salts, amino acid salts, nucleic acid salts, aromatic salts, low solubility salts, and the like, including any disclosed throughout the present disclosure. The purpose of using one or more salts as an excipient includes but is not limited to improving stability and reducing aggregation of an antibody, equalizing ionic charges for other components in the formulation, adjusting solubility of other components in the formulation, adjusting pH and isotonicity, and improving biocompatibility for administration to a subject. Exemplary pharmaceutical antibody formulations disclosed herein comprise NaCl. However, alternative salts may also be used, either instead of NaCl or in addition to NaCl, including but not limited to those provided herein, such as other chloride salts, other sodium salts, ascorbate salts, acetate salts, phosphate salts, citrate salts, Tris salts, or succinate salts, or those otherwise known in the art. In some embodiments, the antibody is an anti-Gal3 antibody.

In some embodiments of the pharmaceutical antibody formulations disclosed herein comprising an antibody and one or more excipients, including the ones comprising one or more amino acids and/or one or more salts as disclosed herein, the one or more excipients comprise one or more surfactants. In some embodiments, the one or more surfactants may comprise surfactants conventionally used as excipients. In some embodiments, the one or more surfactants may include polysorbate, polysorbate 20, polysorbate 40, polysorbate 60, polysorbate 80, oils, poloxamers, poloxamer 188, polyglycosides, cetyl alcohol, cocamides, stearates, laurates, nonoxynols, octoxynols, or other surfactants generally known in the art and used as excipients, including any disclosed throughout the present disclosure. In some embodiments, the surfactants may also act as wetting agents, detergents, or emulsifying agents, depending on the specific surfactant and the intended purpose. The purpose of these surfactants in the pharmaceutical antibody formulations may include but are not limited to improving the solubility of the antibody or the other excipients, improving stability of the antibody, and preventing aggregation of the antibody. Exemplary pharmaceutical antibody formulations disclosed herein comprise a polysorbate. In some embodiments, the polysorbate may be polysorbate 20, polysorbate 40, polysorbate 60, or polysorbate 80, or any combination thereof. In some embodiments, the polysorbate is polysorbate 80. However, alternative surfactants may also be used, either instead of the polysorbate, or in addition to the polysorbate, including but not limited to those provided herein, such as poloxamer 188, or those otherwise known in the art. In some embodiments, the antibody is an anti-Gal3 antibody.

In some embodiments of the pharmaceutical antibody formulations disclosed herein comprising an antibody and one or more excipients, including the ones comprising one or more amino acids, one or more salts, and/or one or more surfactants disclosed herein, the one or more excipients may also comprise one or more sugars or sugar alcohols. In some embodiments, the one or more sugars or sugar alcohols include those conventionally used as excipients. In some embodiments, the sugars include but are not limited to erythrose, arabinose, ribose, deoxyribose, xylose, galactose, glucose (dextrose), fructose, isomaltose, lactose, maltose, sucrose, trehalose, maltodextrin, chitosan, dextrin, dextran, dextran 40, cellulose, or starch, or other sugars generally known in the art and used as excipients, including any disclosed throughout the present disclosure. In some embodiments, the sugar alcohols include but are not limited to glycerol, erythritol, arabitol, xylitol, ribitol, deoxyribitol, mannitol, sorbitol, galactitol, isomalt, maltitol, or lactitol, or other sugar alcohols generally known in the art and used as excipients, including any disclosed throughout the present disclosure. The purpose of these sugars and sugar alcohols in the pharmaceutical antibody formulations may include but are not limited to improving the stability and preventing aggregation of the antibody. Exemplary pharmaceutical antibody formulations disclosed herein may comprise a sugar or a sugar alcohol, or both. In some embodiments, exemplary pharmaceutical antibody formulations comprise sucrose and/or mannitol. However, alternative sugars and sugar alcohols may be used, either instead of the sucrose and/or mannitol, or in addition to the sucrose and/or mannitol, including but not limited to those provided herein, such as sorbitol, trehalose, dextrose, dextran, or dextran 40. In some embodiments, formulations that are intended for subcutaneous use comprise any one or more of the sugars or sugar alcohols disclosed herein, including sucrose and/or mannitol. In some embodiments, formulations that are intended for intravenous use might not comprise any one or more of the sugars or sugar alcohols disclosed herein, including sucrose and/or mannitol. In some embodiments, the antibody is an anti-Gal3 antibody.

In some embodiments, the pharmaceutical antibody formulations comprise an antibody. In some embodiments, the antibody is an anti-Gal3 antibody. In some embodiments, the anti-Gal3 antibody is any one of the anti-Gal3 antibodies disclosed herein, or otherwise known in the art, such as those disclosed in WO 2020/160156. The anti-Gal3 antibody may be a full length antibody, an Fab fragment, an F(ab')$_2$ fragment, an scFv, an sdAb, a monovalent fragment, or any other modified antibody known in the art, including bispecific, trispecific, and other multi-specific variants. The anti-Gal3 antibody will generally comprise complementarity-determining regions (CDRs). In some embodiments, the anti-Gal3 antibody may comprise a heavy chain CDR1 ($V_H$-CDR1), heavy chain CDR2 ($V_H$-CDR2), heavy chain CDR3 ($V_H$-CDR3) and/or light chain CDR1 ($V_L$-CDR1), light chain CDR2 ($V_L$-CDR2), or light chain CDR3 ($V_L$-CDR3), or any combination thereof. In some embodiments, the antibody comprises a $V_H$-CDR1 having the sequence of SEQ ID NO: 31, a $V_H$-CDR2 having the sequence of SEQ ID NO: 72, a $V_H$-CDR3 having the sequence of SEQ ID NO: 113, a $V_L$-CDR1 having the sequence of SEQ ID NO: 171, a $V_L$-CDR2 having the sequence of SEQ ID NO: 222; and a $V_L$-CDR3 having the sequence of SEQ ID NO: 249. In some embodiments, exemplary CDR sequences are depicted in FIGS. 8-13. In some embodiments, each CDR can have up to 1, 2, 3, 4, or 5 amino acids changed from the recited sequence. In some embodiments, each CDR can have a sequence at least 80%, 85%, 90%, 95%, 99%, or 100% identical to those depicted in FIGS. 8-13. In some embodiments, each CDR can have a sequence at least 80%, 85%, 90%, 95%, 99%, or 100% similar to those depicted in FIGS. 8-13. In some embodiments, the anti-Gal3 antibody comprises a VH having a sequence at least 80%, 85%, 90%, 95%, 99%, or 100% identical to that of SEQ ID NO: 298. In some embodiments, the anti-Gal3 antibody comprises a VH having a sequence at least 80%, 85%, 90%, 95%, 99%, or 100% similar to that of SEQ ID NO: 298. In some embodiments, the anti-Gal3 antibody comprises a VL having a sequence at least 80%, 85%, 90%, 95%, 99%, or 100% identical to that of SEQ ID NO: 375. In some embodiments, the anti-Gal3 antibody comprises a VL having a sequence at least 80%, 85%, 90%, 95%, 99%, or 100% similar to that of SEQ ID NO: 375. The pharmaceutical antibody formulations may comprise one or more excipients. In some embodiments, the one or more excipients are present in amounts that are optimized for a certain disease or disorder, to improve stability and/or biocompatibility when administered to a subject. In some embodiments, the one or more excipients may be present in a concentration that is at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, or 200 mM, or any concentration within a range defined by any two of the aforementioned concentrations. The one or more excipient may also be present in a concentration that is at least 0.01%, 0.02%, 0.03%, 0.04%, 0.05%, 0.06%, 0.07%, 0.08%, 0.09%, 0.1%, 0.2%, 0.3%, 0.4%, 0.5%, 0.6%, 0.7%, 0.8%, 0.9%, 1%, 2%, 3%, 4%, 5%, 6%, 7%, 8%, 9%, 10%, 11%, 12%, 13%, 14%, 15%, 16%, 17%, 18%, 19%, or 20%, or any combination within a range within any two of the aforementioned concentrations. In some embodiments, the pharmaceutical antibody formulations further comprise one or more amino acids, one or more salts, or one or more surfactants (which may make up the one or more excipients). The one or more amino acids, one or more salts, and one or more surfactants may be any one of the amino acids, salts, and surfactants disclosed herein. In some embodiments, the one or more amino acids are present at 10 to 50 mM or about 10 to about 50 mM. In some embodiments, the one or more amino acids are present at 20 mM or about 20 mM. In some embodiments, the one or more salts are present at 50 to 150 mM or about 50 to about 150 mM. In some embodiments, the one or more salts are present at 100 mM or about 100 mM. In some embodiments, the one or more surfactants are present at 0.01% to 0.04% or about 0.01% to about 0.04%. In some embodiments, the one or more surfactants are present at 0.02% or about 0.02%. In some embodiments, the formulation is at a pH between 5.3 and 6.3. In some embodiments, the formulation is at a pH of 5.8 or about 5.8. In some embodiments, the antibodies comprise one or more sequences having at least 80%, 81%, 82%, 83%, 84%, 85%, 86%, 87%, 88%, 89%, 90%, 91%, 92%, 93%, 94%, 95%, 96%, 97%, 98%, 99%, or 100% identity to a VL sequence, a VH sequence, a VL/VH pairing, and/or $V_L$-CDR1, $V_L$-CDR2, $V_L$-CDR3, $V_H$-CDR1, $V_H$-CDR2, $V_H$-CDR3 (including 1, 2, 3, 4, or 5 amino acid substitutions of any one or more of these CDRs) set from the heavy chain and light chain sequences as depicted in FIG. 18.

In some embodiments, the pharmaceutical antibody formulations comprise an antibody. In some embodiments, the antibody is an anti-Gal3 antibody. In some embodiments, the anti-Gal3 antibody is any one of the anti-Gal3 antibodies disclosed herein, or otherwise known in the art, such as those disclosed in WO 2020/160156. In some embodiments, the antibody comprises $V_H$-CDR1 having the sequence of SEQ ID NO: 31, a $V_H$-CDR2 having the sequence of SEQ ID NO: 72, a $V_H$-CDR3 having the sequence of SEQ ID NO: 113, a $V_L$-CDR1 having the sequence of SEQ ID NO: 171, a $V_L$-CDR2 having the sequence of SEQ ID NO: 222; and a $V_L$-CDR3 having the sequence of SEQ ID NO: 249. In some embodiments, exemplary CDR sequences are depicted in FIGS. 8-13. In some embodiments, each CDR can have up to 1, 2, 3, 4, or 5 amino acids changed from the recited sequence. In some embodiments, the anti-Gal3 antibody comprises a VH having a sequence at least 80%, 85%, 90%, 95%, 99%, or 100% identical to that of SEQ ID NO: 298. In some embodiments, the anti-Gal3 antibody comprises a VH having a sequence at least 80%, 85%, 90%, 95%, 99%, or 100% similar to that of SEQ ID NO: 298. In some embodiments, the anti-Gal3 antibody comprises having a sequence at least 80%, 85%, 90%, 95%, 99%, or 100% identical to that of SEQ ID NO: 375. In some embodiments, the anti-Gal3 antibody comprises having a sequence at least 80%, 85%, 90%, 95%, 99%, or 100% similar to that of SEQ ID NO: 375. In some embodiments, the pharmaceutical antibody formulations further comprise one or more amino acids, one or more salts, or one or more surfactants. In some embodiments, the one or more amino acids comprise histidine and/or methionine, the one or more salts comprise sodium chloride (NaCl), the one or more surfactants comprise a polysorbate, or any combination thereof. In some embodiments, the pharmaceutical antibody formulations comprise histidine, methionine, NaCl, or polysorbate, or any combination thereof, including all of histidine, methionine, NaCl, and polysorbate. In some embodiments, the histidine may be L-histidine. In some embodiments, the L-histidine is present at 10 to 50 mM or about 10 to about 50 mM, or any amount or concentration envisioned herein. In some embodiments, the L-histidine is present at 20 mM or about 20 mM. In some embodiments, the methionine is present at 2 to 10 mM or about 2 to about 10 mM, or any amount or concentration envisioned herein. In some embodiments, the methionine is present at 5 mM or about 5 mM. In some embodiments, the NaCl is present at 50 to 150 mM or about 50 to about 150 mM, or any amount or concentration envisioned herein. In some embodiments, the NaCl is present at 100 mM or about 100 mM. In some embodiments, the polysorbate comprises polysorbate-20, polysorbate-40, polysorbate-60, polysorbate-80, or any combination thereof. In some embodiments, the polysorbate is or comprises polysorbate-80. In some embodiments, the polysorbate-80 is present at 0.01% to 0.04% or about 0.01% to about 0.04%, or any amount or concentration envisioned herein. In some embodiments, the polysorbate-80 is present at 0.02% or about 0.02%. In some embodiments, the formulation is at a pH between 5.3 and 6.3. In some embodiments, the formulation is at a pH of 5.8 or about 5.8. In some embodiments, the antibodies comprise one or more sequences having at least 80%, 81%, 82%, 83%, 84%, 85%, 86%, 87%, 88%, 89%, 90%, 91%, 92%, 93%, 94%, 95%, 96%, 97%, 98%, 99%, or 100% identity to a VL sequence, a VH sequence, a VL/VH pairing, and/or $V_L$-CDR1, $V_L$-CDR2, $V_L$-CDR3, $V_H$-CDR1, $V_H$-CDR2, $V_H$-CDR3 (including 1, 2, 3, 4, or 5 amino acid substitutions of any one or more of these CDRs) set from the heavy chain and light chain sequences as depicted in FIG. 18.

In some embodiments, the formulation includes one or more of: Polysorbate 80, Polysorbate 20, Poloxamer 188, Mannitol, Sorbitol, Sucrose, Trehalose, Dextrose, Dextran 40, NaCl, Arginine, Glycine, Methionine, Ascorbic acid, NaOAc, Phosphate, Citrate, Acetate, Tris, Succinate, Histidine.

In some embodiments, pharmaceutical antibody formulations are provided. The formulations can include a therapeutically effective amount of an antibody, where the antibody comprises a $V_H$-CDR1 having the sequence of SEQ ID NO: 31, a $V_H$-CDR2 having the sequence of SEQ ID NO: 72, a $V_H$-CDR3 having the sequence of SEQ ID NO: 113, a $V_L$-CDR1 having the sequence of SEQ ID NO: 171, a $V_L$-CDR2 having the sequence of SEQ ID NO: 222; and a $V_L$-CDR3 having the sequence of SEQ ID NO: 249, histidine, methionine, NaCl, and polysorbate. In some embodiments, the formulation can be at a pH between 5.3 and 6.3, which may or may not be accomplished by the addition of the histidine, methionine, NaCl, and/or polysorbate. In some embodiments, the antibody comprises a heavy chain variable domain (VH) region having a sequence at least 80%, 85%, 90%, 95%, 99%, or 100% identical to that of SEQ ID NO: 298. In some embodiments, the antibody comprises a heavy chain variable domain (VH) region having a sequence at least 80%, 85%, 90%, 95%, 99%, or 100% similar to that of SEQ ID NO: 298. In some embodiments, the antibody comprises a light chain variable domain (VL) region having a sequence at least 80%, 85%, 90%, 95%, 99%, or 100% identical to that of SEQ ID NO: 375. In some embodiments, the antibody comprises a light chain variable domain (VL) region having a sequence at least 80%, 85%, 90%, 95%, 99%, or 100% similar to that of SEQ ID NO: 375. In some embodiments, the formulation can also include additional ingredients and/or excipients to those listed, or exclude one or more of the positively recited options. In some embodiments, the ingredients and/or excipients can be replaced or used additionally with one or more alternatives that function to achieve the same result. In some embodiments, the histidine can be replaced with an alternative buffer with an appropriate pKa. In some embodiments, the histidine can be replaced with an alternative that has the same buffer capacity. In some embodiments, the histidine can be replaced with another amino acid. In some embodiments, the histidine can be replaced with an alternative that exhibits the same or similar antibody protective effects. In some embodiments, the histidine can be replaced with an alternative that exhibits the same or similar capacity to reduce aggregation of the antibody. In some embodiments, the histidine can be replaced with an alternative that has the same or similar cryoprotective capabilities. In some embodiments, the methionine can be replaced with an alternative buffer with an appropriate pKa. In some embodiments, the methionine can be replaced with an alternative that has the same buffer capacity. In some embodiments, the methionine can be replaced with another amino acid. In some embodiments, the methionine can be replaced with an alternative that has the same or similar antioxidant effects. In some embodiments, the methionine can be replaced with an alternative that has the same antibody protective effects. In some embodiments, the methionine can be replaced by an alternative that has the same or similar protein stabilization effects. In some embodiments, the methionine can be replaced by an alternative that exhibits the same or similar capacity to reduce aggregation of the antibody, including alternatives that may exhibit any one or more of the properties provided herein. The alternatives for histidine and/or methionine may be any of those provided herein, such as arginine or glycine, or otherwise known in the art. In some embodiments, the NaCl can be replaced with another salt. In some embodiments, the NaCl can be replaced with an alternative that has the same or similar aqueous solubility. In some embodiments, the NaCl can be replaced with an alternative that has the same or similar effect on formulation isotonicity. In some embodiments, the NaCl can be replaced with an alternative that has the same or similar protein stabilization effects, including alternatives that may exhibit any one or more of the properties provided herein. The alternative for NaCl may be any of those provided herein, such as other chloride salts, other sodium salts, ascorbate salts, acetate salts, phosphate salts, citrate salts, Tris salts, or succinate salts, or otherwise known in the art. In some embodiments, the polysorbate can be replaced with another surfactant and/or detergent. In some embodiments, the polysorbate can be replaced with an alternative that has the same or similar surfactant ability/effect. In some embodiments, the polysorbate can be replaced with an alternative that has the same or similar capability for solubilizing antibodies and/or other excipients. In some embodiments, the polysorbate can be replaced with an alternative that has the same or similar capacity to reduce aggregation of the antibody. In some embodiments, the polysorbate can be replaced with an alternative that has the same or similar protein stabilization effects, including alternatives that may exhibit any one or more of the properties provided herein. The alternative for polysorbate may be any of those provided herein, such as poloxamer 188, or otherwise known in the art. In some embodiments, the pH can be acidic, basic, or neutral. In some embodiments, the pH can be basic. In some embodiments, the pH can be varied. In some embodiments, the pH can be increased or decreased in line with the ingredients, excipients, and/or buffers used in the formulation and the particulars of the antibody species used and/or the amount of antibody, ingredients, or excipients used. In some embodiments, the pH can be increased or decreased to a desired pH after adding the antibody, ingredients, or excipients. The alternatives contemplated herein may be any one or more of the excipients, diluents, salts, buffers, and the like, provided throughout the disclosure.

For any of the embodiments of the pharmaceutical antibody formulations provided herein, the histidine is L-histidine, D-histidine, or racemic histidine. For any of the embodiments of the pharmaceutical antibody formulations provided herein, the histidine is racemic histidine. For any of the embodiments of the pharmaceutical antibody formulations provided herein, the histidine is D-histidine. In some embodiments, the histidine can be replaced with an alternative buffer with an appropriate pKa. In some embodiments, the histidine can be replaced with an alternative that has the same buffer capacity. In some embodiments, the histidine can be replaced with another amino acid. In some embodiments, the histidine can be replaced with an alternative that exhibits the same or similar antibody protective effects. In some embodiments, the histidine can be replaced with an alternative that exhibits the same or similar capacity to reduce aggregation of the antibody. In some embodiments, the histidine can be replaced with an alternative that has the same or similar cryoprotective capabilities, including alternatives that may exhibit any one or more of the properties provided herein. The alternatives for histidine may be any of those provided herein, such as arginine or glycine, or otherwise known in the art.

For any of the embodiments of the pharmaceutical antibody formulations provided herein, the histidine may be present in a concentration that is at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, or 200 mM, or any concentration within a range defined by any two of the aforementioned concentrations. In some embodiments, the histidine is present at 10 to 50 mM, e.g. 10, 15, 20, 25, 30, 35, 40, 45, or 50 mM. In some embodiments, the histidine is present at 20 mM or about 20 mM. In some embodiments, where the histidine is L-histidine, the L-histidine is present at 10 to 50 mM, e.g. 10, 15, 20, 25, 30, 35, 40, 45, or 50 mM. In some embodiments, where the histidine is L-histidine, the L-histidine is present at 20 mM or about 20 mM.

For any of the embodiments of the pharmaceutical antibody formulations provided herein, the methionine is L-methionine, D-methionine, or racemic methionine. For any of the embodiments of the pharmaceutical antibody formulations provided herein, the methionine is racemic methionine. For any of the embodiments of the pharmaceutical antibody formulations provided herein, the methionine is D-methionine. In some embodiments, the methionine can be replaced with an alternative buffer with an appropriate pKa. In some embodiments, the methionine can be replaced with an alternative that has the same buffer capacity. In some embodiments, the methionine can be replaced with another amino acid. In some embodiments, the methionine can be replaced with an alternative that has the same or similar antioxidant effects. In some embodiments, the methionine can be replaced with an alternative that has the same antibody protective effects. In some embodiments, the methionine can be replaced by an alternative that has the same or similar protein stabilization effects. In some embodiments, the methionine can be replaced by an alternative that exhibits the same or similar capacity to reduce aggregation of the antibody, including alternatives that may exhibit any one or more of the properties provided herein. The alternatives for methionine may be any of those provided herein, such as arginine or glycine, or otherwise known in the art.

For any of the embodiments of the pharmaceutical antibody formulations provided herein, the methionine may be present in a concentration that is at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, or 200 mM, or any concentration within a range defined by any two of the aforementioned concentrations. In some embodiments, the methionine is present at 2 to 10 mM, e.g. 2, 3, 4, 5, 6, 7, 8, 9, or 10 mM. In some embodiments, the methionine is present at 5 mM or about 5 mM.

For any of the embodiments of the pharmaceutical antibody formulations provided herein, the NaCl may be present in a concentration that is at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, or 200 mM, or any concentration within a range defined by any two of the aforementioned concentrations. In some embodiments, the NaCl is present at 50 to 150 mM, e.g. 50, 60, 70, 80, 90, 100, 110, 120, 130, 140, or 150 mM. In some embodiments, the NaCl is present at 100 mM. In some embodiments, the NaCl can be replaced with another salt. In some embodiments, the NaCl can be replaced with an alternative that has the same or similar aqueous solubility. In some embodiments, the NaCl can be replaced with an alternative that has the same or similar effect on formulation isotonicity. In some embodiments, the NaCl can be replaced with an alternative that has the same or similar protein stabilization effects, including alternatives that may exhibit any one or more of the properties provided herein. The alternative for NaCl may be any of those provided herein, such as other chloride salts, other sodium salts, ascorbate salts, acetate salts, phosphate salts, citrate salts, Tris salts, or succinate salts, or otherwise known in the art.

For any of the embodiments of the pharmaceutical antibody formulations provided herein, the polysorbate comprises polysorbate 20, polysorbate 40, polysorbate 60, polysorbate 80, or any combination thereof. In some embodiments, the polysorbate comprises, consists essentially of, or consists of polysorbate 80. In some embodiments, the polysorbate may be present in a concentration that is at least 0.01%, 0.02%, 0.03%, 0.04%, 0.05%, 0.06%, 0.07%, 0.08%, 0.09%, 0.1%, 0.2%, 0.3%, 0.4%, 0.5%, 0.6%, 0.7%, 0.8%, 0.9%, 1%, 2%, 3%, 4%, 5%, 6%, 7%, 8%, 9%, 10%, 11%, 12%, 13%, 14%, 15%, 16%, 17%, 18%, 19%, or 20%, or any combination within a range within any two of the aforementioned concentrations. In some embodiments, the polysorbate is present at 0.01% to 0.04%, e.g. 0.01%, 0.02%, 0.03%, or 0.04%. In some embodiments, the polysorbate is present at about 0.01% to about 0.04%, e.g. about 0.01%, about 0.02%, about 0.03%, or about 0.04%. In some embodiments, the polysorbate is present at 0.02% or about 0.02%. In some embodiments, where the polysorbate is polysorbate 80, the polysorbate 80 is present at 0.01% to 0.04%, e.g. 0.01%, 0.02%, 0.03%, or 0.04%. In some embodiments, where the polysorbate is polysorbate 80, the polysorbate 80 is present at about 0.01% to about 0.04%, e.g. about 0.01%, about 0.02%, about 0.03%, or about 0.04%. In some embodiments, the polysorbate 80 is present at 0.02% or about 0.02%. In some embodiments, the polysorbate can be replaced with another surfactant and/or detergent. In some embodiments, the polysorbate can be replaced with an alternative that has the same or similar surfactant ability/effect. In some embodiments, the polysorbate can be replaced with an alternative that has the same or similar capability for solubilizing antibodies and/or other excipients. In some embodiments, the polysorbate can be replaced with an alternative that has the same or similar capacity to reduce aggregation of the antibody. In some embodiments, the polysorbate can be replaced with an alternative that has the same or similar protein stabilization effects, including alternatives that may exhibit any one or more of the properties provided herein. The alternative for polysorbate may be any of those provided herein, such as poloxamer 188, or otherwise known in the art.

For any of the embodiments of the pharmaceutical antibody formulations provided herein, the pH is about 5.3, 5.4, 5.5, 5.6, 5.7, 5.8, 5.9, 6.0, 6.1, 6.2, or 6.3. In some embodiments, the pH is about 5.8. In some embodiments, the pH is 5.8. In some embodiments, the pH can be acidic, basic, or neutral. In some embodiments, the pH can be varied. In some embodiments, the pH can be increased or decreased in line with the ingredients, excipients, and/or buffers used in the formulation and the particulars of the antibody species used and/or the amount of antibody, ingredients, or excipients used. In some embodiments, the pH can be increased or decreased to a desired pH after adding the antibody, ingredients, or excipients.

For any of the embodiments of the pharmaceutical antibody formulations provided herein, the formulations further comprise one or more sugars or one or more sugar alcohols, or both, such as the sugars or sugar alcohols disclosed herein or otherwise known in the art. In some embodiments, the one or more sugars comprises sucrose. In some embodiments, the one or more sugar alcohols comprise mannitol. In some embodiments, the formulations comprise sucrose or mannitol, or both. In some embodiments, the formulations comprise sucrose and mannitol. In some embodiments, the sucrose and/or mannitol can be replaced with another sugar and/or sugar alcohol. In some embodiments, the sucrose and/or mannitol can be replaced with an alternative that has the same or similar antibody protective effects. In some embodiments, the sucrose and/or mannitol can be replaced with an alternative that exhibits the same or similar capacity to reduce aggregation of the antibody. In some embodiments, the sucrose and/or mannitol can be replaced with an alternative that has the same or similar cryoprotective capabilities. In some embodiments, the sucrose and/or mannitol can be replaced with an alternative that have the same effect on isotonicity, including alternatives that may exhibit any one or more of the properties provided herein. The alternative for sucrose and/or mannitol may be any of those provided herein, such as sorbitol, trehalose, dextrose, dextran, or dextran 40, or otherwise known in the art.

In some embodiments, the one or more sugars or one or more sugar alcohols may be present in a concentration that is at least 0.01%, 0.02%, 0.03%, 0.04%, 0.05%, 0.06%, 0.07%, 0.08%, 0.09%, 0.1%, 0.2%, 0.3%, 0.4%, 0.5%, 0.6%, 0.7%, 0.8%, 0.9%, 1%, 2%, 3%, 4%, 5%, 6%, 7%, 8%, 9%, 10%, 11%, 12%, 13%, 14%, 15%, 16%, 17%, 18%, 19%, or 20%, or any combination within a range within any two of the aforementioned concentrations. In some embodiments, the one or more sugars or one or more sugar alcohols are present at 2% to 5%, e.g. 2%, 3%, 4%, or 5%. In some embodiments, the one or more sugars or one or more sugar alcohols are present at about 2% to about 5%, e.g. about 2%, about 3%, about 4%, or about 5%. In some embodiments where the sugar is sucrose, the sucrose is present at 2% to 5% or about 2% to 5%. In some embodiments where the sugar alcohol is mannitol, the mannitol is present at 2% to 5% or about 2% to 5%.

For any of the embodiments of the pharmaceutical antibody formulations provided herein, the formulation is configured for parenteral administration. In some embodiments, the formulation is configured for subcutaneous administration. In embodiments where the formulation is configured for subcutaneous administration, the formulation may comprise one or more sugars and/or one or more sugar alcohols. In some embodiments, the formulation configured for subcutaneous administration comprises sucrose or mannitol, or both. In some embodiments, the formulation is configured for intravenous administration. In embodiments where the formulation is configured for intravenous administration, the formulation may not comprise one or more sugars and/or one or more sugar alcohols. In some embodiments, the formulation configured for intravenous administration does not comprise sucrose or mannitol, or both.

For any of the embodiments of the pharmaceutical antibody formulations provided herein, the antibody may be present at an amount that is or is about 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, or 60 mg as a unit dose, or any amount within a range defined by any two of the aforementioned amounts. In some embodiments, the antibody is present at an amount of 1 to 50 mg as a unit dose. In some embodiments, the antibody is present at an amount of one of: 1 mg, 5 mg, 10 mg, 20 mg, 40 mg, or 50 mg as a unit dose, or any amount within a range defined by any two of the aforementioned amounts. In some embodiments, the antibody is present at an amount of 1 mg. In some embodiments, the antibody is present at an amount of 5 mg. In some embodiments, the antibody is present at an amount of 10 mg. In some embodiments, the antibody is present at an amount of 20 mg. In some embodiments, the antibody is present at an amount of 40 mg. In some embodiments, the antibody is present at an amount of 50 mg. In some embodiments, the antibody is present in the formulation at a concentration of one of: 1 mg/mL, 5 mg/mL, 10 mg/mL, 20 mg/mL, 40 mg/mL, or 50 mg/mL, or any concentration within a range defined by any two of the aforementioned concentrations. In some embodiments, the antibody is present at a concentration of 1 mg/mL. In some embodiments, the antibody is present at a concentration of 5 mg/mL. In some embodiments, the antibody is present at a concentration of 10 mg/mL. In some embodiments, the antibody is present at a concentration of 20 mg/mL. In some embodiments, the antibody is present at a concentration of 40 mg/mL. In some embodiments, the antibody is present at a concentration of 50 mg/mL.

In some embodiments of the pharmaceutical antibody formulations, L-histidine is present at about 20 mM, methionine is present at about 5 mM, NaCl is present at about 100 mM, polysorbate 80 is present at about 0.02%, sucrose is present at 2-5%, mannitol is present at 2-5%, the pH of the formulation is about 5.8, and the therapeutically effective amount of the antibody is one of: 1 mg, 5 mg, 10 mg, 20 mg, 40 mg, or 50 mg as a unit dose, or any amount within a range defined by any two of the aforementioned amounts. In some embodiments of the pharmaceutical antibody formulations, L-histidine is present at about 20 mM, methionine is present at about 5 mM, NaCl is present at about 100 mM, polysorbate 80 is present at about 0.02%, sucrose is present at 2-5%, mannitol is present at 2-5%, the pH of the formulation is about 5.8, and the therapeutically effective amount of the antibody is 1 mg as a unit dose. In some embodiments of the pharmaceutical antibody formulations, L-histidine is present at about 20 mM, methionine is present at about 5 mM, NaCl is present at about 100 mM, polysorbate 80 is present at about 0.02%, sucrose is present at 2-5%, mannitol is present at 2-5%, the pH of the formulation is about 5.8, and the therapeutically effective amount of the antibody is 5 mg as a unit dose. In some embodiments of the pharmaceutical antibody formulations, L-histidine is present at about 20 mM, methionine is present at about 5 mM, NaCl is present at about 100 mM, polysorbate 80 is present at about 0.02%, sucrose is present at 2-5%, mannitol is present at 2-5%, the pH of the formulation is about 5.8, and the therapeutically effective amount of the antibody is 10 mg as a unit dose. In some embodiments of the pharmaceutical antibody formulations, L-histidine is present at about 20 mM, methionine is present at about 5 mM, NaCl is present at about 100 mM, polysorbate 80 is present at about 0.02%, sucrose is present at 2-5%, mannitol is present at 2-5%, the pH of the formulation is about 5.8, and the therapeutically effective amount of the antibody is 20 mg as a unit dose. In some embodiments of the pharmaceutical antibody formulations, L-histidine is present at about 20 mM, methionine is present at about 5 mM, NaCl is present at about 100 mM, polysorbate 80 is present at about 0.02%, sucrose is present at 2-5%, mannitol is present at 2-5%, the pH of the formulation is about 5.8, and the therapeutically effective amount of the antibody is 40 mg as a unit dose. In some embodiments of the pharmaceutical antibody formulations, L-histidine is present at about 20 mM, methionine is present at about 5 mM, NaCl is present at about 100 mM, polysorbate 80 is present at about 0.02%, sucrose is present at 2-5%, mannitol is present at 2-5%, the pH of the formulation is about 5.8, and the therapeutically effective amount of the antibody is 50 mg as a unit dose.

In some embodiments, the pharmaceutical antibody formulation comprises a therapeutically effective amount of an antibody. In some embodiments, the antibody comprises a $V_H$-CDR1 having the sequence of SEQ ID NO: 31, a $V_H$-CDR2 having the sequence of SEQ ID NO: 72, a $V_H$-CDR3 having the sequence of SEQ ID NO: 113, a $V_L$-CDR1 having the sequence of SEQ ID NO: 171, a $V_L$-CDR2 having the sequence of SEQ ID NO: 222; and a $V_L$-CDR3 having the sequence of SEQ ID NO: 249. In some embodiments, the antibody is present at an amount as a unit dose of: 1 mg, 5 mg, 10 mg, 20 mg, 40 mg, or 50 mg, or any amount as a unit dose within a range defined by any two of the aforementioned amounts. In some embodiments, the antibody is present at an amount of 1 mg. In some embodiments, the antibody is present at an amount of 5 mg. In some embodiments, the antibody is present at an amount of 10 mg. In some embodiments, the antibody is present at an amount of 20 mg. In some embodiments, the antibody is present at an amount of 40 mg. In some embodiments, the antibody is present at an amount of 50 mg. In some embodiments, the pharmaceutical antibody formulation further comprises L-histidine present at 20 mM, methionine present at 5 mM, NaCl present at 100 mM, polysorbate 80 present at 0.02%. In some embodiments, the pH of the formulation is about 5.8. In some embodiments, the pharmaceutical antibody formulation further comprises sucrose and/or mannitol. In some embodiments, sucrose is present in the formulation at 2-5%. In some embodiments, mannitol is present in the formulation at 2-5%.

In some embodiments of the pharmaceutical antibody formulations disclosed herein, the formulation is configured for parenteral administration. In some embodiments, the formulation is configured for subcutaneous administration. In some embodiments, the formulation configured for subcutaneous administration comprises sucrose or mannitol, or both. In some embodiments, the formulation is configured for intravenous administration. In some embodiments, the formulation configured for intravenous administration does not comprise sucrose or mannitol, or both.

As applied to any of the embodiments of the pharmaceutical antibody formulations disclosed herein, the pharmaceutical antibody formulation is prepared at a concentration of antibody that is or is about 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, or 100 mg/mL, or any concentration within a range defined by any two of the aforementioned concentrations. In some embodiments, the pharmaceutical antibody formulation is prepared at a concentration of 0.3, 0.8, 2.8, 8.4, or 10 mg/mL, or about 0.3, about 0.8, about 2.8, about 8.4, or about 10 mg/mL. In some embodiments, the pharmaceutical antibody formulation is prepared at a concentration of 20 mg/mL or about 20 mg/mL. In some embodiments, the pharmaceutical antibody formulation is prepared at a concentration of 50 mg/mL or about 50 mg/mL.

As applied to any of the embodiments disclosed herein, the pharmaceutical antibody formulation remains at least 60%, 65%, 70%, 75%, 80%, 85%, 90%, 95%, 99%, or 100% stable over 3 months. In some embodiments, the pharmaceutical antibody formulation remains at least 60%, 65%, 70%, 75%, 80%, 85%, 90%, 95%, 99%, or 100% stable over 3 months at either 5° C. or 25° C./60% relative humidity (RH).

In some embodiments of the pharmaceutical antibody formulations disclosed herein, the antibody comprises a heavy chain variable domain (VH) region having a sequence at least 80%, 85%, 90%, 95%, 99%, or 100% identical to that of SEQ ID NO: 298. In some embodiments of the pharmaceutical antibody formulations disclosed herein, the antibody comprises a heavy chain variable domain (VH) region having a sequence at least 80%, 85%, 90%, 95%, 99%, or 100% similar to that of SEQ ID NO: 298. In some embodiments, the antibody comprises a light chain variable domain (VL) region having a sequence at least 80%, 85%, 90%, 95%, 99%, or 100% identical to that of SEQ ID NO: 375. In some embodiments, the antibody comprises a light chain variable domain (VL) region having a sequence at least 80%, 85%, 90%, 95%, 99%, or 100% similar to that of SEQ ID NO: 375. In some embodiments, the antibody comprises a VH region having a sequence at least 80%, 85%, 90%, 95%, 99%, or 100% identical to that of SEQ ID NO: 298, and wherein the antibody comprises a VL region having a sequence at least 80%, 85%, 90%, 95%, 99%, or 100% identical to that of SEQ ID NO: 375. In some embodiments, the antibody comprises a VH region having a sequence at least 80%, 85%, 90%, 95%, 99%, or 100% similar to that of SEQ ID NO: 298, and wherein the antibody comprises a VL region having a sequence at least 80%, 85%, 90%, 95%, 99%, or 100% similar to that of SEQ ID NO: 375. In some embodiments, the antibody comprises a VH region having a sequence of SEQ ID NO: 298. In some embodiments, the antibody comprises a VL region having a sequence of SEQ ID NO: 375. In some embodiments, the antibody comprises a VH region having a sequence of SEQ ID NO: 298, and wherein the antibody comprises a VL region having a sequence of SEQ ID NO: 375. In some embodiments, the antibody comprises a heavy chain (HC) having a sequence at least 80%, 85%, 90%, 95%, 99%, or 100% identical to that of SEQ ID NO: 449. In some embodiments, the antibody comprises a heavy chain (HC) having a sequence at least 80%, 85%, 90%, 95%, 99%, or 100% similar to that of SEQ ID NO: 449. In some embodiments, the antibody comprises a light chain (LC) having a sequence at least 80%, 85%, 90%, 95%, 99%, or 100% identical to that of SEQ ID NO: 496. In some embodiments, the antibody comprises a light chain (LC) having a sequence at least 80%, 85%, 90%, 95%, 99%, or 100% similar to that of SEQ ID NO: 496. In some embodiments, the antibody comprises an HC having a sequence of SEQ ID NO: 449. In some embodiments, the antibody comprises an LC having a sequence of SEQ ID NO: 496. In some embodiments, the antibody is TB006 (4A11.H3L1, IMT006a, IMT006-5). The % identity or % similarity of two sequences is well understood in the art and can be calculated by the number of conserved or similar amino acids or nucleotides relative to the length of the sequences.

In some embodiments of the pharmaceutical antibody formulations disclosed herein, the antibody or a component thereof is encoded by one or more nucleic acids. In some embodiments, the antibody comprises a VH that is encoded by a nucleic acid sequence having at least 80%, 85%, 90%, 95%, 99%, or 100% identical to that of SEQ ID NO: 540. In some embodiments, the antibody comprises a VL that is encoded by a nucleic acid sequence having at least 80%, 85%, 90%, 95%, 99%, or 100% identical to that of SEQ ID NO: 622. In some embodiments, the antibody comprises a VH that is encoded by a nucleic acid sequence of SEQ ID NO: 540. In some embodiments, the antibody comprises a VL that is encoded by a nucleic acid sequence of SEQ ID NO: 622. In some embodiments, the antibody comprises an HC that is encoded by a nucleic acid sequence having at least 80%, 85%, 90%, 95%, 99%, or 100% identical to that of SEQ ID NO: 704. In some embodiments, the antibody comprises an LC that is encoded by a nucleic acid sequence having at least 80%, 85%, 90%, 95%, 99%, or 100% identical to that of SEQ ID NO: 751. In some embodiments, the antibody comprises an HC that is encoded by a nucleic acid sequence of SEQ ID NO: 704. In some embodiments, the antibody comprises an LC that is encoded by a nucleic acid sequence of SEQ ID NO: 751. The % identity of two sequences is well understood in the art and can be calculated by the number of conserved amino acids or nucleotides relative to the length of the sequences.

In some embodiments, the pharmaceutical formulations include, but are not limited to, aqueous liquid dispersions, self-emulsifying dispersions, solid solutions, liposomal dispersions, aerosols, solid dosage forms, powders, immediate release formulations, controlled release formulations, fast melt formulations, tablets, capsules, pills, delayed release formulations, extended release formulations, pulsatile release formulations, multi-particulate formulations (e.g., nanoparticle formulations), and mixed immediate and controlled release formulations.

In some embodiments, the pharmaceutical formulations further include pH adjusting agents or buffering agents which include acids such as acetic, boric, citric, lactic, phosphoric and hydrochloric acids; bases such as sodium hydroxide, sodium phosphate, sodium borate, sodium citrate, sodium acetate, sodium lactate and tris-(hydroxymethyl)aminomethane; and buffers such as citrate/dextrose, sodium bicarbonate and ammonium chloride. Such acids, bases and buffers are included in an amount required to maintain pH of the formulation in an acceptable range.

In some embodiments, the pharmaceutical formulations include one or more salts in an amount required to bring osmolality of the formulation into an acceptable range. Such salts include those having sodium, potassium or ammonium cations and chloride, citrate, ascorbate, borate, phosphate, bicarbonate, sulfate, thiosulfate or bisulfite anions; suitable salts include sodium chloride, potassium chloride, sodium thiosulfate, sodium bisulfite and ammonium sulfate.

In some embodiments, the pharmaceutical formulations further include diluents which are used to stabilize compounds because they can provide a more stable environment. Salts dissolved in buffered solutions (which also can provide pH control or maintenance) are utilized as diluents in the art, including, but not limited to a phosphate buffered saline solution. In certain instances, diluents increase bulk of the formulation to facilitate compression or create sufficient bulk for homogenous blend for capsule filling. Such compounds can include e.g., lactose, starch, mannitol, sorbitol, dextrose, microcrystalline cellulose such as Avicel®; dibasic calcium phosphate, dicalcium phosphate dihydrate; tricalcium phosphate, calcium phosphate; anhydrous lactose, spray-dried lactose; pregelatinized starch, compressible sugar, such as Di-Pac® (Amstar); mannitol, hydroxypropylmethylcellulose, hydroxypropylmethylcellulose acetate stearate, sucrose-based diluents, confectioner's sugar; monobasic calcium sulfate monohydrate, calcium sulfate dihydrate; calcium lactate trihydrate, dextrates; hydrolyzed cereal solids, amylose; powdered cellulose, calcium carbonate; glycine, kaolin; mannitol, sodium chloride; inositol, bentonite, and the like.

In some embodiments, the pharmaceutical formulation is formulated for administration to a subject by one or more administration routes, including but not limited to, parenteral (e.g., intravenous, subcutaneous, intramuscular, intraarterial, intradermal, intraperitoneal, intravitreal, intracerebral, or intracerebroventricular), oral, intranasal, buccal, rectal, or transdermal administration routes. In some embodiments, the pharmaceutical formulation described herein is formulated for parenteral (e.g., intravenous, subcutaneous, intramuscular, intraarterial, intradermal, intraperitoneal, intravitreal, intracerebral, or intracerebroventricular) administration. In some embodiments, the pharmaceutical antibody formulation is formulated for intravenous administration. In some embodiments, the pharmaceutical antibody formulation is formulated for subcutaneous administration. Proper formulation is dependent upon the route of administration chosen. Techniques for formulation and administration of the compounds described herein are known to those skilled in the art.

In some embodiments, the pharmaceutical antibody formulation comprises a therapeutically effective amount of an antibody. In some embodiments, the antibody is an anti-Gal3 antibody.

In some embodiments, the pharmaceutical antibody formulation comprises a therapeutically effective amount of an antibody, histidine, methionine, NaCl, and polysorbate.

In some embodiments, the pharmaceutical antibody formulation comprises a therapeutically effective amount of an antibody, histidine, methionine, NaCl, and polysorbate, where the formulation is at a pH between 5.3 and 6.3.

In some embodiments, the pharmaceutical antibody formulation comprises a therapeutically effective amount of an antibody, histidine, methionine, NaCl, and polysorbate, where the formulation is at a pH between 5.3 and 6.3. In some embodiments, the histidine is L-histidine. In some embodiments, the polysorbate is polysorbate 80. In some embodiments, the histidine is L-histidine and the polysorbate is polysorbate 80. In some embodiments, the pharmaceutical antibody formulation comprises a therapeutically effective amount of an antibody, histidine, methionine, NaCl, and polysorbate, where the formulation is at a pH between 5.3 and 6.3, where the histidine is L-histidine. In some embodiments, the pharmaceutical antibody formulation comprises a therapeutically effective amount of an antibody, histidine, methionine, NaCl, and polysorbate, where the formulation is at a pH between 5.3 and 6.3, where the polysorbate is polysorbate 80. In some embodiments, the pharmaceutical antibody formulation comprises a therapeutically effective amount of an antibody, histidine, methionine, NaCl, and polysorbate, where the formulation is at a pH between 5.3 and 6.3, where the histidine is L-histidine and the polysorbate is polysorbate 80. In some embodiments, the antibody is an anti-Gal3 antibody.

In some embodiments, the pharmaceutical antibody formulation comprises a therapeutically effective amount of an antibody, histidine, methionine, NaCl, and polysorbate, where the formulation is at a pH between 5.3 and 6.3, where the histidine is present at 10 to 50 mM. In some embodiments, the pharmaceutical antibody formulation comprises a therapeutically effective amount of an antibody, histidine, methionine, NaCl, and polysorbate, where the formulation is at a pH between 5.3 and 6.3, where the histidine is present at 20 mM. In some embodiments, the pharmaceutical antibody formulation comprises a therapeutically effective amount of an antibody, histidine, methionine, NaCl, and polysorbate, where the formulation is at a pH between 5.3 and 6.3, where the methionine is present at 2 to 10 mM. In some embodiments, the pharmaceutical antibody formulation comprises a therapeutically effective amount of an antibody, histidine, methionine, NaCl, and polysorbate, where the formulation is at a pH between 5.3 and 6.3, where the methionine is present at 5 mM. In some embodiments, the pharmaceutical antibody formulation comprises a therapeutically effective amount of an antibody, histidine, methionine, NaCl, and polysorbate, where the formulation is at a pH between 5.3 and 6.3, where the NaCl is present at 50 to 150 mM. In some embodiments, the pharmaceutical antibody formulation comprises a therapeutically effective amount of an antibody, histidine, methionine, NaCl, and polysorbate, where the formulation is at a pH between 5.3 and 6.3, where the NaCl is present at 100 mM. In some embodiments, the pharmaceutical antibody formulation comprises a therapeutically effective amount of an antibody, histidine, methionine, NaCl, and polysorbate, where the formulation is at a pH between 5.3 and 6.3, where the polysorbate is present at 0.01 to 0.04%. In some embodiments, the pharmaceutical antibody formulation comprises a therapeutically effective amount of an antibody, histidine, methionine, NaCl, and polysorbate, where the formulation is at a pH between 5.3 and 6.3, where the polysorbate is present at 0.02%. In some embodiments, the histidine is L-histidine. In some embodiments, the polysorbate is polysorbate 20, polysorbate 40, polysorbate 60, or polysorbate 80. In some embodiments, the polysorbate is polysorbate 80. In some embodiments, the pH is 5.8. In some embodiments, the pharmaceutical antibody formulation further comprises sucrose. In some embodiments, the sucrose is present at 2% to 5%. In some embodiments, the pharmaceutical antibody formulation further comprises mannitol. In some embodiments, the mannitol is present at 2% to 5%. In some embodiments, the antibody is an anti-Gal3 antibody.

In some embodiments, the pharmaceutical antibody formulation comprises a therapeutically effective amount of an antibody, where the antibody comprises a $V_H$-CDR1 having the sequence of SEQ ID NO: 31, a $V_H$-CDR2 having the sequence of SEQ ID NO: 72, a $V_H$-CDR3 having the sequence of SEQ ID NO: 113, a $V_L$-CDR1 having the sequence of SEQ ID NO: 171, a $V_L$-CDR2 having the sequence of SEQ ID NO: 222; and a $V_L$-CDR3 having the sequence of SEQ ID NO: 249, histidine, methionine, NaCl, and polysorbate, where the formulation is at a pH between 5.3 and 6.3.

In some embodiments, the pharmaceutical antibody formulation comprises a therapeutically effective amount of an antibody, where the antibody comprises a $V_H$-CDR1 having the sequence of SEQ ID NO: 31, a $V_H$-CDR2 having the sequence of SEQ ID NO: 72, a $V_H$-CDR3 having the sequence of SEQ ID NO: 113, a $V_L$-CDR1 having the sequence of SEQ ID NO: 171, a $V_L$-CDR2 having the sequence of SEQ ID NO: 222; and a $V_L$-CDR3 having the sequence of SEQ ID NO: 249, histidine present at 20 mM, methionine present at 5 mM, NaCl present at 100 mM, and polysorbate present at 0.02%, where the formulation is at a pH between 5.3 and 6.3.

In some embodiments, the pharmaceutical antibody formulation comprises a therapeutically effective amount of an antibody, where the antibody comprises a $V_H$-CDR1 having the sequence of SEQ ID NO: 31, a $V_H$-CDR2 having the sequence of SEQ ID NO: 72, a $V_H$-CDR3 having the sequence of SEQ ID NO: 113, a $V_L$-CDR1 having the sequence of SEQ ID NO: 171, a $V_L$-CDR2 having the sequence of SEQ ID NO: 222; and a $V_L$-CDR3 having the sequence of SEQ ID NO: 249, histidine present at 20 mM, methionine present at 5 mM, NaCl present at 100 mM, and polysorbate present at 0.02%, where the formulation is at a pH of about 5.8.

In some embodiments, the pharmaceutical antibody formulation comprises a therapeutically effective amount of an antibody, where the antibody comprises a $V_H$-CDR1 having the sequence of SEQ ID NO: 31, a $V_H$-CDR2 having the sequence of SEQ ID NO: 72, a $V_H$-CDR3 having the sequence of SEQ ID NO: 113, a $V_L$-CDR1 having the sequence of SEQ ID NO: 171, a $V_L$-CDR2 having the sequence of SEQ ID NO: 222; and a $V_L$-CDR3 having the sequence of SEQ ID NO: 249, L-histidine present at 20 mM, methionine present at 5 mM, NaCl present at 100 mM, and polysorbate 80 present at 0.02%, where the formulation is at a pH between 5.3 and 6.3.

In some embodiments, the pharmaceutical antibody formulation comprises a therapeutically effective amount of an antibody, where the antibody comprises a $V_H$-CDR1 having the sequence of SEQ ID NO: 31, a $V_H$-CDR2 having the sequence of SEQ ID NO: 72, a $V_H$-CDR3 having the sequence of SEQ ID NO: 113, a $V_L$-CDR1 having the sequence of SEQ ID NO: 171, a $V_L$-CDR2 having the sequence of SEQ ID NO: 222; and a $V_L$-CDR3 having the sequence of SEQ ID NO: 249, L-histidine present at 20 mM, methionine present at 5 mM, NaCl present at 100 mM, and polysorbate 80 present at 0.02%, where the formulation is at a pH of about 5.8.

In some embodiments, the pharmaceutical antibody formulation comprises a therapeutically effective amount of an antibody, where the antibody comprises a $V_H$-CDR1 having the sequence of SEQ ID NO: 31, a $V_H$-CDR2 having the sequence of SEQ ID NO: 72, a $V_H$-CDR3 having the sequence of SEQ ID NO: 113, a $V_L$-CDR1 having the sequence of SEQ ID NO: 171, a $V_L$-CDR2 having the sequence of SEQ ID NO: 222; and a $V_L$-CDR3 having the sequence of SEQ ID NO: 249, where the antibody is present at an amount as a unit dose of 1 mg, 5 mg, 10 mg, 20 mg, 40 mg, or 40 mg, histidine present at 20 mM, methionine present at 5 mM, NaCl present at 100 mM, and polysorbate present at 0.02%, where the formulation is at a pH between 5.3 and 6.3.

In some embodiments, the pharmaceutical antibody formulation comprises a therapeutically effective amount of an antibody, where the antibody comprises a $V_H$-CDR1 having the sequence of SEQ ID NO: 31, a $V_H$-CDR2 having the sequence of SEQ ID NO: 72, a $V_H$-CDR3 having the sequence of SEQ ID NO: 113, a $V_L$-CDR1 having the sequence of SEQ ID NO: 171, a $V_L$-CDR2 having the sequence of SEQ ID NO: 222; and a $V_L$-CDR3 having the sequence of SEQ ID NO: 249, where the antibody is present at an amount as a unit dose of 1 mg, 5 mg, 10 mg, 20 mg, 40 mg, or 50 mg, histidine present at 20 mM, methionine present at 5 mM, NaCl present at 100 mM, and polysorbate present at 0.02%, where the formulation is at a pH of about 5.8.

In some embodiments, the pharmaceutical antibody formulation comprises a therapeutically effective amount of an antibody, where the antibody comprises a $V_H$-CDR1 having the sequence of SEQ ID NO: 31, a $V_H$-CDR2 having the sequence of SEQ ID NO: 72, a $V_H$-CDR3 having the sequence of SEQ ID NO: 113, a $V_L$-CDR1 having the sequence of SEQ ID NO: 171, a $V_L$-CDR2 having the sequence of SEQ ID NO: 222; and a $V_L$-CDR3 having the sequence of SEQ ID NO: 249, where the antibody is present at an amount as a unit dose of 1 mg, 5 mg, 10 mg, 20 mg, 40 mg, or 50 mg, L-histidine present at 20 mM, methionine present at 5 mM, NaCl present at 100 mM, and polysorbate 80 present at 0.02%, where the formulation is at a pH between 5.3 and 6.3.

In some embodiments, the pharmaceutical antibody formulation comprises a therapeutically effective amount of an antibody, where the antibody comprises a $V_H$-CDR1 having the sequence of SEQ ID NO: 31, a $V_H$-CDR2 having the sequence of SEQ ID NO: 72, a $V_H$-CDR3 having the sequence of SEQ ID NO: 113, a $V_L$-CDR1 having the sequence of SEQ ID NO: 171, a $V_L$-CDR2 having the sequence of SEQ ID NO: 222; and a $V_L$-CDR3 having the sequence of SEQ ID NO: 249, where the antibody is present at an amount as a unit dose of 1 mg, 50 mg, 10 mg, 20 mg, 40 mg, or 50 mg, L-histidine present at 20 mM, methionine present at 5 mM, NaCl present at 100 mM, and polysorbate 80 present at 0.02%, where the formulation is at a pH of about 5.8.

In some embodiments, the pharmaceutical antibody formulation comprises a therapeutically effective amount of an antibody, where the antibody comprises a VH region having a sequence at least 80%, 85%, 90%, 95%, 99%, or 100% identical to that of SEQ ID NO: 298 and a VL region having a sequence at least 80%, 85%, 90%, 95%, 99%, or 100% identical to that of SEQ ID NO: 375, where the antibody is present at an amount as a unit dose of 1 mg, 5 mg, 10 mg, 20 mg, 40 mg, or 50 mg, histidine present at 20 mM, methionine present at 5 mM, NaCl present at 100 mM, and polysorbate present at 0.02%, where the formulation is at a pH between 5.3 and 6.3.

In some embodiments, the pharmaceutical antibody formulation comprises a therapeutically effective amount of an antibody, where the antibody comprises a VH region having a sequence at least 80%, 85%, 90%, 95%, 99%, or 100% identical to that of SEQ ID NO: 298 and a VL region having a sequence at least 80%, 85%, 90%, 95%, 99%, or 100% identical to that of SEQ ID NO: 375, where the antibody is present at an amount as a unit dose of 1 mg, 5 mg, 10 mg, 20 mg, 40 mg, or 50 mg, histidine present at 20 mM, methionine present at 5 mM, NaCl present at 100 mM, and polysorbate present at 0.02%, where the formulation is at a pH of about 5.8.

In some embodiments, the pharmaceutical antibody formulation comprises a therapeutically effective amount of an antibody, where the antibody comprises a VH region having a sequence at least 80%, 85%, 90%, 95%, 99%, or 100% identical to that of SEQ ID NO: 298 and a VL region having a sequence at least 80%, 85%, 90%, 95%, 99%, or 100% identical to that of SEQ ID NO: 375, where the antibody is present at an amount as a unit dose of 1 mg, 5 mg, 10 mg, 20 mg, 40 mg, or 50 mg, L-histidine present at 20 mM, methionine present at 5 mM, NaCl present at 100 mM, and polysorbate 80 present at 0.02%, where the formulation is at a pH between 5.3 and 6.3.

In some embodiments, the pharmaceutical antibody formulation comprises a therapeutically effective amount of an antibody, where the antibody comprises a VH region having a sequence at least 80%, 85%, 90%, 95%, 99%, or 100% identical to that of SEQ ID NO: 298 and a VL region having a sequence at least 80%, 85%, 90%, 95%, 99%, or 100% identical to that of SEQ ID NO: 375, where the antibody is present at an amount as a unit dose of 1 mg, 5 mg, 10 mg, 20 mg, 40 mg, or 50 mg, L-histidine present at 20 mM, methionine present at 5 mM, NaCl present at 100 mM, and polysorbate 80 present at 0.02%, where the formulation is at a pH of about 5.8.

In some embodiments, the pharmaceutical antibody formulation comprises a therapeutically effective amount of an antibody, where the antibody comprises a $V_H$-CDR1 having the sequence of SEQ ID NO: 31, a $V_H$-CDR2 having the sequence of SEQ ID NO: 72, a $V_H$-CDR3 having the sequence of SEQ ID NO: 113, a $V_L$-CDR1 having the sequence of SEQ ID NO: 171, a $V_L$-CDR2 having the sequence of SEQ ID NO: 222; and a $V_L$-CDR3 having the sequence of SEQ ID NO: 249, where the antibody is present at an amount of 1 mg as a unit dose, L-histidine present at 20 mM, methionine present at 5 mM, NaCl present at 100 mM, polysorbate 80 present at 0.02% and where the pH is about 5.8.

In some embodiments, the pharmaceutical antibody formulation comprises a therapeutically effective amount of an antibody, where the antibody comprises a $V_H$-CDR1 having the sequence of SEQ ID NO: 31, a $V_H$-CDR2 having the sequence of SEQ ID NO: 72, a $V_H$-CDR3 having the sequence of SEQ ID NO: 113, a $V_L$-CDR1 having the sequence of SEQ ID NO: 171, a $V_L$-CDR2 having the sequence of SEQ ID NO: 222; and a $V_L$-CDR3 having the sequence of SEQ ID NO: 249, where the antibody is present at an amount of 5 mg as a unit dose, L-histidine present at 20 mM, methionine present at 5 mM, NaCl present at 100 mM, polysorbate 80 present at 0.02% and where the pH is about 5.8.

In some embodiments, the pharmaceutical antibody formulation comprises a therapeutically effective amount of an antibody, where the antibody comprises a $V_H$-CDR1 having the sequence of SEQ ID NO: 31, a $V_H$-CDR2 having the sequence of SEQ ID NO: 72, a $V_H$-CDR3 having the sequence of SEQ ID NO: 113, a $V_L$-CDR1 having the sequence of SEQ ID NO: 171, a $V_L$-CDR2 having the sequence of SEQ ID NO: 222; and a $V_L$-CDR3 having the sequence of SEQ ID NO: 249, where the antibody is present at an amount of 10 mg as a unit dose, L-histidine present at 20 mM, methionine present at 5 mM, NaCl present at 100 mM, polysorbate 80 present at 0.02% and where the pH is about 5.8.

In some embodiments, the pharmaceutical antibody formulation comprises a therapeutically effective amount of an antibody, where the antibody comprises a $V_H$-CDR1 having the sequence of SEQ ID NO: 31, a $V_H$-CDR2 having the sequence of SEQ ID NO: 72, a $V_H$-CDR3 having the sequence of SEQ ID NO: 113, a $V_L$-CDR1 having the sequence of SEQ ID NO: 171, a $V_L$-CDR2 having the sequence of SEQ ID NO: 222; and a $V_L$-CDR3 having the sequence of SEQ ID NO: 249, where the antibody is present at an amount of 20 mg as a unit dose, L-histidine present at 20 mM, methionine present at 5 mM, NaCl present at 100 mM, polysorbate 80 present at 0.02% and where the pH is about 5.8.

In some embodiments, the pharmaceutical antibody formulation comprises a therapeutically effective amount of an antibody, where the antibody comprises a $V_H$-CDR1 having the sequence of SEQ ID NO: 31, a $V_H$-CDR2 having the sequence of SEQ ID NO: 72, a $V_H$-CDR3 having the sequence of SEQ ID NO: 113, a $V_L$-CDR1 having the sequence of SEQ ID NO: 171, a $V_L$-CDR2 having the sequence of SEQ ID NO: 222; and a $V_L$-CDR3 having the sequence of SEQ ID NO: 249, where the antibody is present at an amount of 40 mg as a unit dose, L-histidine present at 20 mM, methionine present at 5 mM, NaCl present at 100 mM, polysorbate 80 present at 0.02% and where the pH is about 5.8.

In some embodiments, the pharmaceutical antibody formulation comprises a therapeutically effective amount of an antibody, where the antibody comprises a $V_H$-CDR1 having the sequence of SEQ ID NO: 31, a $V_H$-CDR2 having the sequence of SEQ ID NO: 72, a $V_H$-CDR3 having the sequence of SEQ ID NO: 113, a $V_L$-CDR1 having the sequence of SEQ ID NO: 171, a $V_L$-CDR2 having the sequence of SEQ ID NO: 222; and a $V_L$-CDR3 having the sequence of SEQ ID NO: 249, where the antibody is present at an amount of 50 mg as a unit dose, L-histidine present at 20 mM, methionine present at 5 mM, NaCl present at 100 mM, polysorbate 80 present at 0.02% and where the pH is about 5.8.

In some embodiments, the pharmaceutical antibody formulation comprises a therapeutically effective amount of an antibody, where the antibody comprises a VH region having a sequence at least 80%, 85%, 90%, 95%, 99%, or 100% identical to that of SEQ ID NO: 298 and a VL region having a sequence at least 80%, 85%, 90%, 95%, 99%, or 100% identical to that of SEQ ID NO: 375, where the antibody is present at an amount of 1 mg as a unit dose, L-histidine present at 20 mM, methionine present at 5 mM, NaCl present at 100 mM, polysorbate 80 present at 0.02% and where the pH is about 5.8.

In some embodiments, the pharmaceutical antibody formulation comprises a therapeutically effective amount of an antibody, where the antibody comprises a VH region having a sequence at least 80%, 85%, 90%, 95%, 99%, or 100% identical to that of SEQ ID NO: 298 and a VL region having a sequence at least 80%, 85%, 90%, 95%, 99%, or 100% identical to that of SEQ ID NO: 375, where the antibody is present at an amount of 5 mg as a unit dose, L-histidine present at 20 mM, methionine present at 5 mM, NaCl present at 100 mM, polysorbate 80 present at 0.02% and where the pH is about 5.8.

In some embodiments, the pharmaceutical antibody formulation comprises a therapeutically effective amount of an antibody, where the antibody comprises a VH region having a sequence at least 80%, 85%, 90%, 95%, 99%, or 100% identical to that of SEQ ID NO: 298 and a VL region having a sequence at least 80%, 85%, 90%, 95%, 99%, or 100% identical to that of SEQ ID NO: 375, where the antibody is present at an amount of 10 mg as a unit dose, L-histidine present at 20 mM, methionine present at 5 mM, NaCl present at 100 mM, polysorbate 80 present at 0.02% and where the pH is about 5.8.

In some embodiments, the pharmaceutical antibody formulation comprises a therapeutically effective amount of an antibody, where the antibody comprises a VH region having a sequence at least 80%, 85%, 90%, 95%, 99%, or 100% identical to that of SEQ ID NO: 298 and a VL region having a sequence at least 80%, 85%, 90%, 95%, 99%, or 100% identical to that of SEQ ID NO: 375, where the antibody is present at an amount of 20 mg as a unit dose, L-histidine present at 20 mM, methionine present at 5 mM, NaCl present at 100 mM, polysorbate 80 present at 0.02% and where the pH is about 5.8.

In some embodiments, the pharmaceutical antibody formulation comprises a therapeutically effective amount of an antibody, where the antibody comprises a VH region having a sequence at least 80%, 85%, 90%, 95%, 99%, or 100% identical to that of SEQ ID NO: 298 and a VL region having a sequence at least 80%, 85%, 90%, 95%, 99%, or 100% identical to that of SEQ ID NO: 375, where the antibody is present at an amount of 40 mg as a unit dose, L-histidine present at 20 mM, methionine present at 5 mM, NaCl present at 100 mM, polysorbate 80 present at 0.02% and where the pH is about 5.8.

In some embodiments, the pharmaceutical antibody formulation comprises a therapeutically effective amount of an antibody, where the antibody comprises a VH region having a sequence at least 80%, 85%, 90%, 95%, 99%, or 100% identical to that of SEQ ID NO: 298 and a VL region having a sequence at least 80%, 85%, 90%, 95%, 99%, or 100% identical to that of SEQ ID NO: 375, where the antibody is present at an amount of 50 mg as a unit dose, L-histidine present at 20 mM, methionine present at 5 mM, NaCl present at 100 mM, polysorbate 80 present at 0.02% and where the pH is about 5.8.

Exemplary Articles of Manufacture and Kits

Disclosed herein, in certain embodiments, are kits and articles of manufacture for use with one or more of the compositions and methods described herein. Such kits include a carrier, package, or container that is compartmentalized to receive one or more containers such as vials, tubes, and the like, each of the container(s) comprising one of the separate elements to be used in a method described herein. Suitable containers include, for example, bottles, vials, syringes, and test tubes. In one embodiment, the containers are formed from a variety of materials such as glass or plastic.

The articles of manufacture provided herein contain packaging materials. Examples of pharmaceutical packaging materials include, but are not limited to, blister packs, bottles, tubes, bags, containers, bottles, and any packaging material suitable for a selected formulation and intended mode of administration and treatment.

For example, the container(s) include an anti-Gal3 antibody or binding fragment thereof as disclosed herein, host cells for producing one or more antibodies described herein, and/or vectors comprising nucleic acid molecules that encode the antibodies described herein. Such kits optionally include an identifying description or label or instructions relating to its use in the methods described herein.

A kit typically includes labels listing contents and/or instructions for use, and package inserts with instructions for use. A set of instructions will also typically be included.

In one embodiment, a label is on or associated with the container. In one embodiment, a label is on a container when letters, numbers or other characters forming the label are attached, molded or etched into the container itself; a label is associated with a container when it is present within a receptacle or carrier that also holds the container, e.g., as a package insert. In one embodiment, a label is used to indicate that the contents are to be used for a specific therapeutic application. The label also indicates directions for use of the contents, such as in the methods described herein.

In certain embodiments, the pharmaceutical compositions are presented in a pack or dispenser device which contains one or more unit dosage forms containing a compound provided herein. The pack, for example, contains metal or plastic foil, such as a blister pack. In one embodiment, the pack or dispenser device is accompanied by instructions for administration. In one embodiment, the pack or dispenser is also accompanied with a notice associated with the container in form prescribed by a governmental agency regulating the manufacture, use, or sale of pharmaceuticals, which notice is reflective of approval by the agency of the form of the drug for human or veterinary administration. Such notice, for example, is the labeling approved by the U.S. Food and Drug Administration for prescription drugs, or the approved product insert. In one embodiment, compositions containing a compound provided herein formulated in a compatible pharmaceutical carrier are also prepared, placed in an appropriate container, and labeled for treatment of an indicated condition.

In some embodiments, sterile vials comprising pharmaceutical antibody formulations are provided, where the formulations can include a therapeutically effective amount of an antibody. In some embodiments, the sterile vials comprise any one of the pharmaceutical antibody formulations disclosed herein. In some embodiments, the antibody comprises a $V_H$-CDR1 having the sequence of SEQ ID NO: 31, a $V_H$-CDR2 having the sequence of SEQ ID NO: 72, a $V_H$-CDR3 having the sequence of SEQ ID NO: 113, a $V_L$-CDR1 having the sequence of SEQ ID NO: 171, a $V_L$-CDR2 having the sequence of SEQ ID NO: 222; and a $V_L$-CDR3 having the sequence of SEQ ID NO: 249. In some embodiments, the antibody comprises a $V_H$-CDR1 that is at least 80%, 81%, 82%, 83%, 84%, 85%, 86%, 87%, 88%, 89%, 90%, 91%, 92%, 93%, 94%, 95%, 96%, 97%, 98%, 99%, or 100% identical to the sequence of SEQ ID NO: 31, a $V_H$-CDR2 that is at least 80%, 81%, 82%, 83%, 84%, 85%, 86%, 87%, 88%, 89%, 90%, 91%, 92%, 93%, 94%, 95%, 96%, 97%, 98%, 99%, or 100% identical to the sequence of SEQ ID NO: 72, a $V_H$-CDR3 that is at least 80%, 81%, 82%, 83%, 84%, 85%, 86%, 87%, 88%, 89%, 90%, 91%, 92%, 93%, 94%, 95%, 96%, 97%, 98%, 99%, or 100% identical to the sequence of SEQ ID NO: 113, a $V_L$-CDR1 that is at least 80%, 81%, 82%, 83%, 84%, 85%, 86%, 87%, 88%, 89%, 90%, 91%, 92%, 93%, 94%, 95%, 96%, 97%, 98%, 99%, or 100% identical to the sequence of SEQ ID NO: 171, a $V_L$-CDR2 that is at least 80%, 81%, 82%, 83%, 84%, 85%, 86%, 87%, 88%, 89%, 90%, 91%, 92%, 93%, 94%, 95%, 96%, 97%, 98%, 99%, or 100% identical to the sequence of SEQ ID NO: 222; and a $V_L$-CDR3 that is at least 80%, 81%, 82%, 83%, 84%, 85%, 86%, 87%, 88%, 89%, 90%, 91%, 92%, 93%, 94%, 95%, 96%, 97%, 98%, 99%, or 100% identical to the sequence of SEQ ID NO: 249. In some embodiments, the antibody comprises a $V_H$-CDR1 that is at least 80%, 81%, 82%, 83%, 84%, 85%, 86%, 87%, 88%, 89%, 90%, 91%, 92%, 93%, 94%, 95%, 96%, 97%, 98%, 99%, or 100% similar to the sequence of SEQ ID NO: 31, a $V_H$-CDR2 that is at least 80%, 81%, 82%, 83%, 84%, 85%, 86%, 87%, 88%, 89%, 90%, 91%, 92%, 93%, 94%, 95%, 96%, 97%, 98%, 99%, or 100% similar to the sequence of SEQ ID NO: 72, a $V_H$-CDR3 that is at least 80%, 81%, 82%, 83%, 84%, 85%, 86%, 87%, 88%, 89%, 90%, 91%, 92%, 93%, 94%, 95%, 96%, 97%, 98%, 99%, or 100% similar to the sequence of SEQ ID NO: 113, a $V_L$-CDR1 that is at least 80%, 81%, 82%, 83%, 84%, 85%, 86%, 87%, 88%, 89%, 90%, 91%, 92%, 93%, 94%, 95%, 96%, 97%, 98%, 99%, or 100% similar to the sequence of SEQ ID NO: 171, a $V_L$-CDR2 that is at least 80%, 81%, 82%, 83%, 84%, 85%, 86%, 87%, 88%, 89%, 90%, 91%, 92%, 93%, 94%, 95%, 96%, 97%, 98%, 99%, or 100% similar to the sequence of SEQ ID NO: 222; and a $V_L$-CDR3 that is at least 80%, 81%, 82%, 83%, 84%, 85%, 86%, 87%, 88%, 89%, 90%, 91%, 92%, 93%, 94%, 95%, 96%, 97%, 98%, 99%, or 100% similar to the sequence of SEQ ID NO: 249. In some embodiments, the pharmaceutical antibody formulations can further comprise histidine, methionine, NaCl, and polysorbate. In some embodiments, the formulation can be at a pH between 5.3 and 6.3. In some embodiments, the antibody can be an anti-Gal3 antibody. In some embodiments, the antibody can be an anti-Gal3 antibody disclosed herein, or otherwise known in the art, such as those disclosed in WO 2020/160156. In some embodiments, the antibody comprises a heavy chain variable domain (VH) region having a sequence at least 80%, 85%, 90%, 95%, 99%, or 100% identical to that of SEQ ID NO: 298. In some embodiments, the antibody comprises a heavy chain variable domain (VH) region having a sequence at least 80%, 85%, 90%, 95%, 99%, or 100% similar to that of SEQ ID NO: 298. In some embodiments, the antibody comprises a light chain variable domain (VL) region having a sequence at least 80%, 85%, 90%, 95%, 99%, or 100% identical to that of SEQ ID NO: 375. In some embodiments, the antibody comprises a light chain variable domain (VL) region having a sequence at least 80%, 85%, 90%, 95%, 99%, or 100% similar to that of SEQ ID NO: 375. In some embodiments, the formulation can also include additional ingredients and/or excipients to those listed, or exclude one or more of the positively recited options. In some embodiments, the ingredients and/or excipients can be replaced or used additionally with one or more alternatives that function to achieve the same result. In some embodiments, the histidine can be replaced with an alternative buffer with an appropriate pKa. In some embodiments, the histidine can be replaced with an alternative that has the same buffer capacity. In some embodiments, the histidine can be replaced with another amino acid. In some embodiments, the histidine can be replaced with an alternative that exhibits the same or similar antibody protective effects. In some embodiments, the histidine can be replaced with an alternative that exhibits the same or similar capacity to reduce aggregation of the antibody. In some embodiments, the histidine can be replaced with an alternative that has the same or similar cryoprotective capabilities, including alternatives that may exhibit any one or more of the properties provided herein. In some embodiments, the methionine can be replaced with an alternative buffer with an appropriate pKa. In some embodiments, the methionine can be replaced with an alternative that has the same buffer capacity. In some embodiments, the methionine can be replaced with another amino acid. In some embodiments, the methionine can be replaced with an alternative that has the same or similar antioxidant effects. In some embodiments, the methionine can be replaced with an alternative that has the same antibody protective effects. In some embodiments, the methionine can be replaced by an alternative that has the same or similar protein stabilization effects. In some embodiments, the methionine can be replaced by an alternative that exhibits the same or similar capacity to reduce aggregation of the antibody, including alternatives that may exhibit any one or more of the properties provided herein. The alternatives for histidine and/or methionine may be any of those provided herein, such as arginine or glycine, or otherwise known in the art. In some embodiments, the NaCl can be replaced with another salt. In some embodiments, the NaCl can be replaced with an alternative that has the same or similar aqueous solubility. In some embodiments, the NaCl can be replaced with an alternative that has the same or similar effect on formulation isotonicity. In some embodiments, the NaCl can be replaced with an alternative that has the same or similar protein stabilization effects, including alternatives that may exhibit one or more of the properties provided herein. The alternative for NaCl may be any of those provided herein, such as other chloride salts, other sodium salts, ascorbate salts, acetate salts, phosphate salts, citrate salts, Tris salts, or succinate salts, or otherwise known in the art. In some embodiments, the polysorbate can be replaced with another surfactant and/or detergent. In some embodiments, the polysorbate can be replaced with an alternative that has the same or similar surfactant ability/effect. In some embodiments, the polysorbate can be replaced with an alternative that has the same or similar capability for solubilizing antibodies and/or other excipients. In some embodiments, the polysorbate can be replaced with an alternative that has the same or similar capacity to reduce aggregation of the antibody. In some embodiments, the polysorbate can be replaced with an alternative that has the same or similar protein stabilization effects, including alternatives that may exhibit one or more of the properties provided herein. The alternative for polysorbate may be any of those provided herein, such as poloxamer 188, or otherwise known in the art. In some embodiments, the pH can be acidic. In some embodiments, the pH can be basic. In some embodiments, the pH can be varied. In some embodiments, the pH can be increased or decreased in line with the ingredients, excipients, and/or buffers used in the formulation and the particulars of the antibody species used and/or the amount of antibody, ingredients, or excipients used. In some embodiments, the pH can be increased or decreased to a desired pH after adding the antibody, ingredients, or excipients. The alternatives contemplated herein may be any one or more of the excipients, diluents, salts, buffers, and the like, provided throughout the disclosure. In some embodiments, the antibodies comprise one or more sequences having at least 80%, 81%, 82%, 83%, 84%, 85%, 86%, 87%, 88%, 89%, 90%, 91%, 92%, 93%, 94%, 95%, 96%, 97%, 98%, 99%, or 100% identity to a VL sequence, a VH sequence, a VL/VH pairing, and/or $V_L$-CDR1, $V_L$-CDR2, $V_L$-CDR3, $V_H$-CDR1, $V_H$-CDR2, $V_H$-CDR3 (including 1, 2, 3, 4, or 5 amino acid substitutions of any one or more of these CDRs) set from the heavy chain and light chain sequences as depicted in FIG. 18.

For any of the embodiments of the sterile vials comprising pharmaceutical antibody formulations provided herein, the histidine is L-histidine, D-histidine, or racemic histidine. For any of the embodiments of the pharmaceutical antibody formulations provided herein, the histidine is racemic histidine. For any of the embodiments of the pharmaceutical antibody formulations provided herein, the histidine is D-histidine. In some embodiments, the histidine can be replaced with an alternative buffer with an appropriate pKa. In some embodiments, the histidine can be replaced with an alternative that has the same buffer capacity. In some embodiments, the histidine can be replaced with another amino acid. In some embodiments, the histidine can be replaced with an alternative that exhibits the same or similar antibody protective effects. In some embodiments, the histidine can be replaced with an alternative that exhibits the same or similar capacity to reduce aggregation of the antibody. In some embodiments, the histidine can be replaced with an alternative that has the same or similar cryoprotective capabilities, including alternatives that may exhibit one or more of the properties provided herein. The alternatives for histidine may be any of those provided herein, such as arginine or glycine, or otherwise known in the art.

For any of the embodiments of the sterile vials comprising pharmaceutical antibody formulations provided herein, the histidine is present at 10 to 50 mM, e.g. 10, 15, 20, 25, 30, 35, 40, 45, or 50 mM. In some embodiments, the histidine is present at 20 mM or about 20 mM. In some embodiments, where the histidine is L-histidine, the L-histidine is present at 10 to 50 mM, e.g. 10, 15, 20, 25, 30, 35, 40, 45, or 50 mM. In some embodiments, where the histidine is L-histidine, the L-histidine is present at 20 mM or about 20 mM.

For any of the embodiments of the sterile vials comprising pharmaceutical antibody formulations provided herein, the methionine is L-methionine. For any of the embodiments of the pharmaceutical antibody formulations provided herein, the methionine is racemic methionine. For any of the embodiments of the pharmaceutical antibody formulations provided herein, the methionine is D-methionine. In some embodiments, the methionine can be replaced with an alternative buffer with an appropriate pKa. In some embodiments, the methionine can be replaced with an alternative that has the same buffer capacity. In some embodiments, the methionine can be replaced with another amino acid. In some embodiments, the methionine can be replaced with an alternative that has the same or similar antioxidant effects. In some embodiments, the methionine can be replaced with an alternative that has the same antibody protective effects. In some embodiments, the methionine can be replaced by an alternative that has the same or similar protein stabilization effects. In some embodiments, the methionine can be replaced by an alternative that exhibits the same or similar capacity to reduce aggregation of the antibody, including alternatives that may exhibit one or more of the properties provided herein. The alternatives for methionine may be any of those provided herein, such as arginine or glycine, or otherwise known in the art.

For any of the embodiments of the sterile vials comprising pharmaceutical antibody formulations provided herein, the methionine is present at 2 to 10 mM, e.g. 2, 3, 4, 5, 6, 7, 8, 9, or 10 mM. In some embodiments, the methionine is present at 5 mM or about 5 mM.

For any of the embodiments of the sterile vials comprising pharmaceutical antibody formulations provided herein, the NaCl is present at 50 to 150 mM, e.g. 50, 60, 70, 80, 90, 100, 110, 120, 130, 140, or 150 mM. In some embodiments, the NaCl is present at 100 mM. In some embodiments, the NaCl can be replaced with another salt. In some embodiments, the NaCl can be replaced with an alternative that has the same or similar aqueous solubility. In some embodiments, the NaCl can be replaced with an alternative that has the same or similar effect on formulation isotonicity. In some embodiments, the NaCl can be replaced with an alternative that has the same or similar protein stabilization effects, including alternatives that may exhibit one or more of the properties provided herein. The alternative for NaCl may be any of those provided herein, such as other chloride salts, other sodium salts, ascorbate salts, acetate salts, phosphate salts, citrate salts, Tris salts, or succinate salts, or otherwise known in the art.

For any of the embodiments of the sterile vials comprising pharmaceutical antibody formulations provided herein, the polysorbate comprises polysorbate 20, polysorbate 40, polysorbate 60, polysorbate 80, or any combination thereof. In some embodiments, the polysorbate comprises, consists essentially of, or consists of polysorbate 80. In some embodiments, the polysorbate is present at 0.01% to 0.04%, e.g. 0.01%, 0.02%, 0.03%, or 0.04%. In some embodiments, the polysorbate is present at about 0.01% to about 0.04%, e.g. about 0.01%, about 0.02%, about 0.03%, or about 0.04%. In some embodiments, the polysorbate is present at 0.02% or about 0.02%. In some embodiments, where the polysorbate is polysorbate 80, the polysorbate 80 is present at 0.01% to 0.04%, e.g. 0.01%, 0.02%, 0.03%, or 0.04%. In some embodiments, where the polysorbate is polysorbate 80, the polysorbate 80 is present at about 0.01% to about 0.04%, e.g. about 0.01%, about 0.02%, about 0.03%, or about 0.04%. In some embodiments, the polysorbate 80 is present at 0.02% or about 0.02%. In some embodiments, the polysorbate can be replaced with another surfactant and/or detergent. In some embodiments, the polysorbate can be replaced with an alternative that has the same or similar surfactant ability/effect. In some embodiments, the polysorbate can be replaced with an alternative that has the same or similar capability for solubilizing antibodies and/or other excipients. In some embodiments, the polysorbate can be replaced with an alternative that has the same or similar capacity to reduce aggregation of the antibody. In some embodiments, the polysorbate can be replaced with an alternative that has the same or similar protein stabilization effects, including alternatives that may exhibit one or more of the properties provided herein. The alternative for polysorbate may be any of those provided herein, such as poloxamer 188, or otherwise known in the art.

For any of the embodiments of the sterile vials comprising pharmaceutical antibody formulations provided herein, the pH is about 5.8. In some embodiments, the pH is 5.8. In some embodiments, the pH can be acidic. In some embodiments, the pH can be basic. In some embodiments, the pH can be varied. In some embodiments, the pH can be increased or decreased in line with the ingredients, excipients, and/or buffers used in the formulation and the particulars of the antibody species used and/or the amount of antibody, ingredients, or excipients used. In some embodiments, the pH can be increased or decreased to a desired pH after adding the antibody, ingredients, or excipients.

For any of the embodiments of the sterile vials comprising pharmaceutical antibody formulations provided herein, the formulations further comprise one or more sugars or one or more sugar alcohols, or both, including any one of the sugars or sugar alcohols disclosed herein or otherwise known in the art. In some embodiments, the one or more sugars comprises sucrose. In some embodiments, the one or more sugar alcohols comprise mannitol. In some embodiments, the formulations comprise sucrose or mannitol, or both. In some embodiments, the formulations comprise sucrose and mannitol. In some embodiments, the sucrose and/or mannitol can be replaced with another sugar and/or sugar alcohol. In some embodiments, the sucrose and/or mannitol can be replaced with an alternative that has the same or similar antibody protective effects. In some embodiments, the sucrose and/or mannitol can be replaced with an alternative that exhibits the same or similar capacity to reduce aggregation of the antibody. In some embodiments, the sucrose and/or mannitol can be replaced with an alternative that has the same or similar cryoprotective capabilities. In some embodiments, the sucrose and/or mannitol can be replaced with an alternative that have the same effect on isotonicity, including alternatives that may exhibit one or more of the properties provided herein. The alternative for sucrose and/or mannitol may be any of those provided herein, such as sorbitol, trehalose, dextrose, dextran, or dextran 40, or otherwise known in the art.

In some embodiments, the one or more sugars or one or more sugar alcohols are present at 2% to 5%, e.g. 2%, 3%, 4%, or 5%. In some embodiments, the one or more sugars or one or more sugar alcohols are present at about 2% to about 5%, e.g. about 2%, about 3%, about 4%, or about 5%. In some embodiments where the sugar is sucrose, the sucrose is present at 2% to 5% or about 2% to 5%. In some embodiments where the sugar alcohol is mannitol, the mannitol is present at 2% to 5% or about 2% to 5%.

For any of the embodiments of the sterile vials comprising pharmaceutical antibody formulations provided herein, the formulation is configured for parenteral administration. In some embodiments, the formulation is configured for subcutaneous administration. In some embodiments, the formulation configured for subcutaneous administration comprises one or more sugars and/or one or more sugar alcohols. In some embodiments, the formulation configured for subcutaneous administration comprises sucrose or mannitol, or both. In some embodiments, the formulation is configured for intravenous administration. In some embodiments, the formulation configured for intravenous administration does not comprise one or more sugars and/or one or more sugar alcohols. In some embodiments, the formulation configured for intravenous administration does not comprise sucrose or mannitol, or both.

In some embodiments are sterile vials comprising a pharmaceutical antibody formulation comprising a therapeutically effective amount of an antibody, such as an anti-Gal3 antibody. In some embodiments, the sterile vials comprise any of the pharmaceutical antibody formulations disclosed herein. In some embodiments, the pharmaceutical antibody formulation comprises a therapeutically effective amount of an antibody. In some embodiments, the antibody is an anti-Gal3 antibody. In some embodiments, the antibody is any one of the anti-Gal3 antibodies disclosed herein or otherwise known in the art, such as those described in WO 2020/160156. In some embodiments, the antibody comprises a $V_H$-CDR1 having the sequence of SEQ ID NO: 31, a $V_H$-CDR2 having the sequence of SEQ ID NO: 72, a $V_H$-CDR3 having the sequence of SEQ ID NO: 113, a $V_L$-CDR1 having the sequence of SEQ ID NO: 171, a $V_L$-CDR2 having the sequence of SEQ ID NO: 222; and a $V_L$-CDR3 having the sequence of SEQ ID NO: 249. In some embodiments, the antibody comprises a $V_H$-CDR1 that is at least 80%, 81%, 82%, 83%, 84%, 85%, 86%, 87%, 88%, 89%, 90%, 91%, 92%, 93%, 94%, 95%, 96%, 97%, 98%, 99%, or 100% identical to the sequence of SEQ ID NO: 31, a $V_H$-CDR2 that is at least 80%, 81%, 82%, 83%, 84%, 85%, 86%, 87%, 88%, 89%, 90%, 91%, 92%, 93%, 94%, 95%, 96%, 97%, 98%, 99%, or 100% identical to the sequence of SEQ ID NO: 72, a $V_H$-CDR3 that is at least 80%, 81%, 82%, 83%, 84%, 85%, 86%, 87%, 88%, 89%, 90%, 91%, 92%, 93%, 94%, 95%, 96%, 97%, 98%, 99%, or 100% identical to the sequence of SEQ ID NO: 113, a $V_L$-CDR1 that is at least 80%, 81%, 82%, 83%, 84%, 85%, 86%, 87%, 88%, 89%, 90%, 91%, 92%, 93%, 94%, 95%, 96%, 97%, 98%, 99%, or 100% identical to the sequence of SEQ ID NO: 171, a $V_L$-CDR2 that is at least 80%, 81%, 82%, 83%, 84%, 85%, 86%, 87%, 88%, 89%, 90%, 91%, 92%, 93%, 94%, 95%, 96%, 97%, 98%, 99%, or 100% identical to the sequence of SEQ ID NO: 222; and a $V_L$-CDR3 that is at least 80%, 81%, 82%, 83%, 84%, 85%, 86%, 87%, 88%, 89%, 90%, 91%, 92%, 93%, 94%, 95%, 96%, 97%, 98%, 99%, or 100% identical to the sequence of SEQ ID NO: 249. In some embodiments, the antibody comprises a $V_H$-CDR1 that is at least 80%, 81%, 82%, 83%, 84%, 85%, 86%, 87%, 88%, 89%, 90%, 91%, 92%, 93%, 94%, 95%, 96%, 97%, 98%, 99%, or 100% similar to the sequence of SEQ ID NO: 31, a $V_H$-CDR2 that is at least 80%, 81%, 82%, 83%, 84%, 85%, 86%, 87%, 88%, 89%, 90%, 91%, 92%, 93%, 94%, 95%, 96%, 97%, 98%, 99%, or 100% similar to the sequence of SEQ ID NO: 72, a $V_H$-CDR3 that is at least 80%, 81%, 82%, 83%, 84%, 85%, 86%, 87%, 88%, 89%, 90%, 91%, 92%, 93%, 94%, 95%, 96%, 97%, 98%, 99%, or 100% similar to the sequence of SEQ ID NO: 113, a $V_L$-CDR1 that is at least 80%, 81%, 82%, 83%, 84%, 85%, 86%, 87%, 88%, 89%, 90%, 91%, 92%, 93%, 94%, 95%, 96%, 97%, 98%, 99%, or 100% similar to the sequence of SEQ ID NO: 171, a $V_L$-CDR2 that is at least 80%, 81%, 82%, 83%, 84%, 85%, 86%, 87%, 88%, 89%, 90%, 91%, 92%, 93%, 94%, 95%, 96%, 97%, 98%, 99%, or 100% similar to the sequence of SEQ ID NO: 222; and a $V_L$-CDR3 that is at least 80%, 81%, 82%, 83%, 84%, 85%, 86%, 87%, 88%, 89%, 90%, 91%, 92%, 93%, 94%, 95%, 96%, 97%, 98%, 99%, or 100% similar to the sequence of SEQ ID NO: 249. In some embodiments, the antibody comprises a $V_H$-CDR1 having a sequence that has at least 0, 1, 2, 3, 4, 5, or 6 substitutions relative to the sequence of SEQ ID NO: 31, a $V_H$-CDR2 having a sequence that has at least 0, 1, 2, 3, 4, 5, or 6 substitutions relative to the sequence of SEQ ID NO: 72, a $V_H$-CDR3 having a sequence that has at least 0, 1, 2, 3, 4, 5, or 6 substitutions relative to the sequence of SEQ ID NO: 113, a $V_L$-CDR1 having a sequence that has at least 0, 1, 2, 3, 4, 5, or 6 substitutions relative to the sequence of SEQ ID NO: 171, a $V_L$-CDR2 having a sequence that has at least 0, 1, 2, 3, 4, 5, or 6 substitutions relative to the sequence of SEQ ID NO: 222; and a $V_L$-CDR3 having a sequence that has at least 0, 1, 2, 3, 4, 5, or 6 substitutions relative to the sequence of SEQ ID NO: 249. In some embodiments, the pharmaceutical antibody formulation in the sterile vial further comprises histidine, methionine, NaCl, and polysorbate. In some embodiments, the pharmaceutical antibody formulation in the sterile vial is at a pH between 5.3 and 6.3. In some embodiments, the sterile vial is a 1, 2, 3, 4, 5, 6, 7, 8, 9, or 10 mL sterile vial. In some embodiments, the sterile vial is a 5 mL sterile vial. In some embodiments, the sterile vial is a 10 mL sterile vial. In some embodiments, the sterile vial contains 1, 2, 3, 4, 5, 6, 7, 8, 9, or 10 mL of the pharmaceutical antibody formulation. In some embodiments, the sterile vial contains 2 mL or at least 2 mL of the pharmaceutical antibody formulation. In some embodiments, the sterile vial contains 8 mL or at least 8 mL of the pharmaceutical antibody formulation. In some embodiments, the pharmaceutical antibody formulation in the sterile vial is a concentrated form of any one of the pharmaceutical antibody formulations disclosed herein. In some embodiments, the concentrated form of the pharmaceutical antibody formulation in the sterile vial is at a concentration of 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, or 100 mg/mL. In some embodiments, the concentrated form of the pharmaceutical antibody formation in the sterile vial is at a concentration of 20 mg/mL or about 20 mg/mL or at least 20 mg/mL. In some embodiments, the concentrated form of the pharmaceutical antibody formulation in the sterile vial is at a concentration of 50 mg/mL or about 50 mg/mL or at least 50 mg/mL. In some embodiments, the sterile vial contains 1, 2, 3, 4, 5, 6, 7, 8, 9, or 10 mL of the concentrated form of the pharmaceutical antibody formulation, where the concentrated form of the pharmaceutical antibody formulation is at a concentration of 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, or 100 mg/mL of antibody. In some embodiments, the sterile vial comprises 10, 20, 30, 40, 50, 60, 70, 80, 90, 100, 110, 120, 130, 140, 150, 160, 170, 180, 190, 200, 210, 220, 230, 240, 250, 260, 270, 280, 290, 300, 310, 320, 330, 340, 350, 360, 370, 380, 390, 400, 410, 420, 430, 440, 450, 460, 470, 480, 490, 500, 510, 520, 530, 540, 550, 560, 570, 580, 590, 600, 610, 620, 630, 640, 650, 660, 670, 680, 690, 700, 710, 720, 730, 740, 750, 760, 770, 780, 790, 800, 810, 820, 830, 840, 850, 860, 870, 880, 890, 900, 910, 920, 930, 940, 950, 960, 970, 980, 990, or 1000 mg of the antibody, or any amount of antibody within a range defined by any two of the aforementioned amounts. In some embodiments, the concentrated form of the pharmaceutical antibody formulation in the sterile vial is intended to be diluted 1×, 2×, 3×, 4×, 5×, 6×, 7×, 8×, 9×, 10×, 11×, 12×, 13×, 14×, 15×, 16×, 17×, 18×, 19×, 20×, 30×, 40×, 50×, 60×, 70×, 80×, 90×, or 100× fold, or any fold within a range defined by any two of the aforementioned fold. In some embodiments, the concentrated form of the pharmaceutical antibody formulation in the sterile vial is intended to be diluted to 0.1, 0.2, 0.3, 0.4, 0.5, 0.6, 0.7, 0.8, 0.9, 1, 2, 3, 4, 5, 6, 7, 8, 9, 10, 11, 12, 13, 14, 15, 16, 17, 18, 19, or 20 mg/mL or any concentration within a range defined by any two of the aforementioned concentrations. In some embodiments, the concentrated form of the pharmaceutical antibody formulation is intended to be diluted into a final volume of 200, 210, 220, 230, 240, 250, 260, 270, 280, 290, 300, 310, 320, 330, 340, 350, 360, 370, 380, 390, 400, 410, 420, 430, 440, 450, 460, 470, 480, 490, 500, 510, 520, 530, 540, 550, 560, 570, 580, 590, or 600 mL. In some embodiments, the concentrated form of the pharmaceutical antibody formulation is intended to be diluted into a final volume of 250 mL or 500 mL. In some embodiments, the concentrated form of the pharmaceutical antibody formulation in the sterile vial is intended to be diluted with saline. In some embodiments, the saline is 0.9% saline. In some embodiments, the pharmaceutical antibody formulation in the sterile vial is configured for parenteral administration. In some embodiments, the pharmaceutical antibody formulation in the sterile vial is configured for subcutaneous administration. In some embodiments, the pharmaceutical antibody formulation in the sterile vial configured for subcutaneous administration comprises sucrose or mannitol, or both. In some embodiments, the pharmaceutical antibody formulation in the sterile vial is configured for intravenous administration. In some embodiments, the pharmaceutical antibody formulation in the sterile vial configured for intravenous administration does not comprise sucrose or mannitol, or both. In some embodiments, the pharmaceutical antibody formulation remains 60%, 65%, 70%, 75%, 80%, 85%, 90%, 95%, 99%, or 100% stable over 3 months. In some embodiments, the pharmaceutical antibody formulation remains 60%, 65%, 70%, 75%, 80%, 85%, 90%, 95%, 99%, or 100% stable over 3 months at either 5° C. or 25° C./60% relative humidity (RH).

In some embodiments, the sterile vial comprises a pharmaceutical antibody formulation comprising a therapeutically effective amount of an antibody or a concentrated form of the pharmaceutical antibody formulation, where the antibody comprises a $V_H$-CDR1 having the sequence of SEQ ID NO: 31, a $V_H$-CDR2 having the sequence of SEQ ID NO: 72, a $V_H$-CDR3 having the sequence of SEQ ID NO: 113, a $V_L$-CDR1 having the sequence of SEQ ID NO: 171, a $V_L$-CDR2 having the sequence of SEQ ID NO: 222; and a $V_L$-CDR3 having the sequence of SEQ ID NO: 249 (or at least 80%, 81%, 82%, 83%, 84%, 85%, 86%, 87%, 88%, 89%, 90%, 91%, 92%, 93%, 94%, 95%, 96%, 97%, 98%, 99%, or 100% identical or similar to the respective sequence), where the antibody is present at an amount of 1 mg as a unit dose, L-histidine present at 20 mM, methionine present at 5 mM, NaCl present at 100 mM, polysorbate 80 present at 0.02% and where the pH is about 5.8. In some embodiments, the pharmaceutical antibody formulation is a concentrated form. In some embodiments, the pharmaceutical antibody formulation is at a concentration of 20 mg/mL or about 20 mg/mL of antibody. In some embodiments, the pharmaceutical antibody formulation is at a concentration of 50 mg/mL or about 50 mg/mL of antibody.

In some embodiments, the sterile vial comprises a pharmaceutical antibody formulation comprising a therapeutically effective amount of an antibody or a concentrated form of the pharmaceutical antibody formulation, where the antibody comprises a $V_H$-CDR1 having the sequence of SEQ ID NO: 31, a $V_H$-CDR2 having the sequence of SEQ ID NO: 72, a $V_H$-CDR3 having the sequence of SEQ ID NO: 113, a $V_L$-CDR1 having the sequence of SEQ ID NO: 171, a $V_L$-CDR2 having the sequence of SEQ ID NO: 222; and a $V_L$-CDR3 having the sequence of SEQ ID NO: 249 (or at least 80%, 81%, 82%, 83%, 84%, 85%, 86%, 87%, 88%, 89%, 90%, 91%, 92%, 93%, 94%, 95%, 96%, 97%, 98%, 99%, or 100% identical or similar to the respective sequence), where the antibody is present at an amount of 5 mg as a unit dose, L-histidine present at 20 mM, methionine present at 5 mM, NaCl present at 100 mM, polysorbate 80 present at 0.02% and where the pH is about 5.8. In some embodiments, the pharmaceutical antibody formulation is a concentrated form. In some embodiments, the pharmaceutical antibody formulation is at a concentration of 20 mg/mL or about 20 mg/mL of antibody. In some embodiments, the pharmaceutical antibody formulation is at a concentration of 50 mg/mL or about 50 mg/mL of antibody.

In some embodiments, the sterile vial comprises a pharmaceutical antibody formulation comprising a therapeutically effective amount of an antibody or a concentrated form of the pharmaceutical antibody formulation, where the antibody comprises a $V_H$-CDR1 having the sequence of SEQ ID NO: 31, a V$_H$-CDR2 having the sequence of SEQ ID NO: 72, a V$_H$-CDR3 having the sequence of SEQ ID NO: 113, a V$_L$-CDR1 having the sequence of SEQ ID NO: 171, a V$_L$-CDR2 having the sequence of SEQ ID NO: 222; and a V$_L$-CDR3 having the sequence of SEQ ID NO: 249 (or at least 80%, 81%, 82%, 83%, 84%, 85%, 86%, 87%, 88%, 89%, 90%, 91%, 92%, 93%, 94%, 95%, 96%, 97%, 98%, 99%, or 100% identical or similar to the respective sequence), where the antibody is present at an amount of 10 mg as a unit dose, L-histidine present at 20 mM, methionine present at 5 mM, NaCl present at 100 mM, polysorbate 80 present at 0.02% and where the pH is about 5.8. In some embodiments, the pharmaceutical antibody formulation is a concentrated form. In some embodiments, the pharmaceutical antibody formulation is at a concentration of 20 mg/mL or about 20 mg/mL of antibody. In some embodiments, the pharmaceutical antibody formulation is at a concentration of 50 mg/mL or about 50 mg/mL of antibody.

In some embodiments, the sterile vial comprises a pharmaceutical antibody formulation comprising a therapeutically effective amount of an antibody or a concentrated form of the pharmaceutical antibody formulation, where the antibody comprises a V$_H$-CDR1 having the sequence of SEQ ID NO: 31, a V$_H$-CDR2 having the sequence of SEQ ID NO: 72, a V$_H$-CDR3 having the sequence of SEQ ID NO: 113, a V$_L$-CDR1 having the sequence of SEQ ID NO: 171, a V$_L$-CDR2 having the sequence of SEQ ID NO: 222; and a V$_L$-CDR3 having the sequence of SEQ ID NO: 249 (or at least 80%, 81%, 82%, 83%, 84%, 85%, 86%, 87%, 88%, 89%, 90%, 91%, 92%, 93%, 94%, 95%, 96%, 97%, 98%, 99%, or 100% identical or similar to the respective sequence), where the antibody is present at an amount of 20 mg as a unit dose, L-histidine present at 20 mM, methionine present at 5 mM, NaCl present at 100 mM, polysorbate 80 present at 0.02% and where the pH is about 5.8. In some embodiments, the pharmaceutical antibody formulation is a concentrated form. In some embodiments, the pharmaceutical antibody formulation is at a concentration of 20 mg/mL or about 20 mg/mL of antibody. In some embodiments, the pharmaceutical antibody formulation is at a concentration of 50 mg/mL or about 50 mg/mL of antibody.

In some embodiments, the sterile vial comprises a pharmaceutical antibody formulation comprising a therapeutically effective amount of an antibody or a concentrated form of the pharmaceutical antibody formulation, where the antibody comprises a V$_H$-CDR1 having the sequence of SEQ ID NO: 31, a V$_H$-CDR2 having the sequence of SEQ ID NO: 72, a V$_H$-CDR3 having the sequence of SEQ ID NO: 113, a V$_L$-CDR1 having the sequence of SEQ ID NO: 171, a V$_L$-CDR2 having the sequence of SEQ ID NO: 222; and a V$_L$-CDR3 having the sequence of SEQ ID NO: 249 (or at least 80%, 81%, 82%, 83%, 84%, 85%, 86%, 87%, 88%, 89%, 90%, 91%, 92%, 93%, 94%, 95%, 96%, 97%, 98%, 99%, or 100% identical or similar to the respective sequence), where the antibody is present at an amount of 40 mg as a unit dose, L-histidine present at 20 mM, methionine present at 5 mM, NaCl present at 100 mM, polysorbate 80 present at 0.02% and where the pH is about 5.8. In some embodiments, the pharmaceutical antibody formulation is a concentrated form. In some embodiments, the pharmaceutical antibody formulation is at a concentration of 20 mg/mL or about 20 mg/mL of antibody. In some embodiments, the pharmaceutical antibody formulation is at a concentration of 50 mg/mL or about 50 mg/mL of antibody.

In some embodiments, the sterile vial comprises a pharmaceutical antibody formulation comprising a therapeutically effective amount of an antibody or a concentrated form of the pharmaceutical antibody formulation, where the antibody comprises a V$_H$-CDR1 having the sequence of SEQ ID NO: 31, a V$_H$-CDR2 having the sequence of SEQ ID NO: 72, a V$_H$-CDR3 having the sequence of SEQ ID NO: 113, a V$_L$-CDR1 having the sequence of SEQ ID NO: 171, a V$_L$-CDR2 having the sequence of SEQ ID NO: 222; and a V$_L$-CDR3 having the sequence of SEQ ID NO: 249 (or at least 80%, 81%, 82%, 83%, 84%, 85%, 86%, 87%, 88%, 89%, 90%, 91%, 92%, 93%, 94%, 95%, 96%, 97%, 98%, 99%, or 100% identical or similar to the respective sequence), where the antibody is present at an amount of 50 mg as a unit dose, L-histidine present at 20 mM, methionine present at 5 mM, NaCl present at 100 mM, polysorbate 80 present at 0.02% and where the pH is about 5.8. In some embodiments, the pharmaceutical antibody formulation is a concentrated form. In some embodiments, the pharmaceutical antibody formulation is at a concentration of 20 mg/mL about 20 mg/mL of antibody. In some embodiments, the pharmaceutical antibody formulation is at a concentration of 50 mg/mL or about 50 mg/mL of antibody.

In some embodiments, the sterile vial comprises a pharmaceutical antibody formulation comprising a therapeutically effective amount of an antibody or a concentrated form of the pharmaceutical antibody formulation, where the antibody comprises a VH region having a sequence at least 80%, 85%, 90%, 95%, 99%, or 100% identical to that of SEQ ID NO: 298 and a VL region having a sequence at least 80%, 85%, 90%, 95%, 99%, or 100% identical or similar to that of SEQ ID NO: 375, where the antibody is present at an amount of 1 mg as a unit dose, L-histidine present at 20 mM, methionine present at 5 mM, NaCl present at 100 mM, polysorbate 80 present at 0.02% and where the pH is about 5.8. In some embodiments, the pharmaceutical antibody formulation is a concentrated form. In some embodiments, the pharmaceutical antibody formulation is at a concentration of 20 mg/mL or about 20 mg/mL of antibody. In some embodiments, the pharmaceutical antibody formulation is at a concentration of 50 mg/mL or about 50 mg/mL of antibody.

In some embodiments, the sterile vial comprises a pharmaceutical antibody formulation comprising a therapeutically effective amount of an antibody or a concentrated form of the pharmaceutical antibody formulation, where the antibody comprises a VH region having a sequence at least 80%, 85%, 90%, 95%, 99%, or 100% identical to that of SEQ ID NO: 298 and a VL region having a sequence at least 80%, 85%, 90%, 95%, 99%, or 100% identical or similar to that of SEQ ID NO: 375, where the antibody is present at an amount of 5 mg as a unit dose, L-histidine present at 20 mM, methionine present at 5 mM, NaCl present at 100 mM, polysorbate 80 present at 0.02% and where the pH is about 5.8. In some embodiments, the pharmaceutical antibody formulation is a concentrated form. In some embodiments, the pharmaceutical antibody formulation is at a concentration of 20 mg/mL or about 20 mg/mL of antibody. In some embodiments, the pharmaceutical antibody formulation is at a concentration of 50 mg/mL or about 50 mg/mL of antibody.

In some embodiments, the sterile vial comprises a pharmaceutical antibody formulation comprising a therapeutically effective amount of an antibody or a concentrated form of the pharmaceutical antibody formulation, where the antibody comprises a VH region having a sequence at least 80%, 85%, 90%, 95%, 99%, or 100% identical or similar to that of SEQ ID NO: 298 and a VL region having a sequence at least 80%, 85%, 90%, 95%, 99%, or 100% identical or similar to that of SEQ ID NO: 375, where the antibody is present at an amount of 10 mg as a unit dose, L-histidine present at 20 mM, methionine present at 5 mM, NaCl present at 100 mM, polysorbate 80 present at 0.02% and where the pH is about 5.8. In some embodiments, the pharmaceutical antibody formulation is a concentrated form. In some embodiments, the pharmaceutical antibody formulation is at a concentration of 20 mg/mL or about 20 mg/mL of antibody. In some embodiments, the pharmaceutical antibody formulation is at a concentration of 50 mg/mL or about 50 mg/mL of antibody.

In some embodiments, the sterile vial comprises a pharmaceutical antibody formulation comprising a therapeutically effective amount of an antibody or a concentrated form of the pharmaceutical antibody formulation, where the antibody comprises a VH region having a sequence at least 80%, 85%, 90%, 95%, 99%, or 100% identical or similar to that of SEQ ID NO: 298 and a VL region having a sequence at least 80%, 85%, 90%, 95%, 99%, or 100% identical or similar to that of SEQ ID NO: 375, where the antibody is present at an amount of 20 mg as a unit dose, L-histidine present at 20 mM, methionine present at 5 mM, NaCl present at 100 mM, polysorbate 80 present at 0.02% and where the pH is about 5.8. In some embodiments, the pharmaceutical antibody formulation is a concentrated form. In some embodiments, the pharmaceutical antibody formulation is at a concentration of 20 mg/mL or about 20 mg/mL of antibody. In some embodiments, the pharmaceutical antibody formulation is at a concentration of 50 mg/mL or about 50 mg/mL of antibody.

In some embodiments, the sterile vial comprises a pharmaceutical antibody formulation comprising a therapeutically effective amount of an antibody or a concentrated form of the pharmaceutical antibody formulation, where the antibody comprises a VH region having a sequence at least 80%, 85%, 90%, 95%, 99%, or 100% identical or similar to that of SEQ ID NO: 298 and a VL region having a sequence at least 80%, 85%, 90%, 95%, 99%, or 100% identical or similar to that of SEQ ID NO: 375, where the antibody is present at an amount of 40 mg as a unit dose, L-histidine present at 20 mM, methionine present at 5 mM, NaCl present at 100 mM, polysorbate 80 present at 0.02% and where the pH is about 5.8. In some embodiments, the pharmaceutical antibody formulation is a concentrated form. In some embodiments, the pharmaceutical antibody formulation is at a concentration of 20 mg/mL or about 20 mg/mL of antibody. In some embodiments, the pharmaceutical antibody formulation is at a concentration of 50 mg/mL or about 50 mg/mL of antibody.

In some embodiments, the sterile vial comprises a pharmaceutical antibody formulation comprising a therapeutically effective amount of an antibody or a concentrated form of the pharmaceutical antibody formulation, where the antibody comprises a VH region having a sequence at least 80%, 85%, 90%, 95%, 99%, or 100% identical or similar to that of SEQ ID NO: 298 and a VL region having a sequence at least 80%, 85%, 90%, 95%, 99%, or 100% identical or similar to that of SEQ ID NO: 375, where the antibody is present at an amount of 50 mg as a unit dose, L-histidine present at 20 mM, methionine present at 5 mM, NaCl present at 100 mM, polysorbate 80 present at 0.02% and where the pH is about 5.8. In some embodiments, the pharmaceutical antibody formulation is a concentrated form. In some embodiments, the pharmaceutical antibody formulation is at a concentration of 20 mg/mL or about 20 mg/mL of antibody. In some embodiments, the pharmaceutical antibody formulation is at a concentration of 50 mg/mL or about 50 mg/mL of antibody.

In some embodiments, the sterile vial can be substituted with a suitable alternative container, such as a tube, bag, pack, syringe, or dispenser. In some embodiments, the vial or alternative container may be contained within a kit for use. In some embodiments, the kit may contain identifying description, label, or instructions relating to its use in the methods disclosed herein. In some embodiments, the kit also includes a notice prescribed by a government agency regulating the manufacture, use, or sale of pharmaceuticals, denoting approval of the form of the drug for human or veterinary administration.

Exemplary Methods of Use and Therapeutic Regimens

In some embodiments, the anti-Gal3 antibodies or binding fragments thereof disclosed herein are administered for therapeutic applications. In some embodiments, the anti-Gal3 antibody or binding fragment thereof is administered once per day, twice per day, three times per day or more. In some embodiments, the anti-Gal3 antibody or binding fragment thereof is administered daily, every day, every alternate day, five days a week, once a week, every other week, two weeks per month, three weeks per month, once a month, twice a month, three times per month, or more. In some embodiments, the anti-Gal3 antibody or binding fragment thereof is administered for at least 1 month, 2 months, 3 months, 4 months, 5 months, 6 months, 7 months, 8 months, 9 months, 10 months, 11 months, 12 months, 18 months, 2 years, 3 years, or more.

In the case wherein the patient's status does improve, upon the doctor's discretion the administration of the anti-Gal3 antibody or binding fragment thereof is given continuously; alternatively, the dose of the anti-Gal3 antibody or binding fragment thereof being administered is temporarily reduced or temporarily suspended for a certain length of time (i.e., a "drug holiday"). In some embodiments, the length of the drug holiday varies between 2 days and 1 year, including by way of example only, 2 days, 3 days, 4 days, 5 days, 6 days, 7 days, 10 days, 12 days, 15 days, 20 days, 28 days, 35 days, 50 days, 70 days, 100 days, 120 days, 150 days, 180 days, 200 days, 250 days, 280 days, 300 days, 320 days, 350 days, or 365 days. The dose reduction during a drug holiday is from 10%-100%, including, by way of example only, 10%, 15%, 20%, 25%, 30%, 35%, 40%, 45%, 50%, 55%, 60%, 65%, 70%, 75%, 80%, 85%, 90%, 95%, or 100%.

Once improvement of the patient's condition has occurred, a maintenance dose is administered if necessary. Subsequently, the dosage or the frequency of administration, or both, can be reduced, as a function of the symptoms, to a level at which the improved disease, disorder, or condition is retained.

In some embodiments, the amount of a given agent that correspond to such an amount varies depending upon factors such as the particular compound, the severity of the disease, the identity (e.g., weight) of the subject or host in need of treatment, but nevertheless is routinely determined in a manner known in the art according to the particular circumstances surrounding the case, including, e.g., the specific agent being administered, the route of administration, and the subject or host being treated. In some embodiments, the desired dose is conveniently presented in a single dose or as divided doses administered simultaneously (or over a short period of time) or at appropriate intervals, for example as two, three, four or more sub-doses per day.

The foregoing ranges are merely suggestive, as the number of variables in regard to an individual treatment regime is large, and considerable excursions from these recommended values are not uncommon. Such dosages is altered depending on a number of variables, not limited to the activity of the compound used, the disease or condition to be treated, the mode of administration, the requirements of the individual subject, the severity of the disease or condition being treated, and the judgment of the practitioner.

In some embodiments, toxicity and therapeutic efficacy of such therapeutic regimens are determined by standard pharmaceutical procedures in cell cultures or experimental animals, including, but not limited to, the determination of the LD50 (the dose lethal to 50% of the population) and the ED50 (the dose therapeutically effective in 50% of the population). The dose ratio between the toxic and therapeutic effects is the therapeutic index and it is expressed as the ratio between LD50 and ED50. Compounds exhibiting high therapeutic indices are preferred. The data obtained from cell culture assays and animal studies are used in formulating a range of dosage for use in human. The dosage of such compounds lies preferably within a range of circulating concentrations that include the ED50 with minimal toxicity. The dosage varies within this range depending upon the dosage form employed and the route of administration utilized.

In some embodiments, the methods and uses disclosed herein are directed to the treatment of a disease or disorder in a subject. In some embodiments, the methods and uses are directed to administering a protein to a subject having, suspected of having, or at risk of developing a disease or disorder. In some embodiments, the protein is an anti-Gal3 antibody or binding fragment thereof. In some embodiments, the disease or disorder is a viral infection. In some embodiments, the disease or disorder is a coronavirus infection. In some embodiments, the disease or disorder is a SARS-CoV-2 viral infection. In some embodiments, the methods and uses are directed to treating a sequela that arises from a disease or disorder. In some embodiments, the sequela is lung fibrosis or other fibrosis or sequela caused by a SARS-CoV-2 viral infection. In some embodiments, the disease or disorder is an inflammatory disease, which may or may not be associated with a viral infection. In some embodiments, the inflammatory disease may be a lung inflammatory disease (e.g. COPD), or an autoimmune disease (e.g. systemic lupus erythematosus). In some embodiments, the inflammatory disease is associated with neutrophil activation and/or migration in the subject.

In some embodiments, a method of treating lung fibrosis in a subject in need thereof is provided. The method comprises administering to the subject a protein. In some embodiments, the protein is an anti-Gal3 antibody or binding fragment thereof. In some embodiments, the anti-Gal3 antibody or binding fragment is specific for the N-terminal domain of Gal3, N-terminus of Gal3, or the TRD of Gal3. The anti-Gal3 antibody or binding fragment thereof disrupts an interaction between Gal3 and a TGF-b receptor. In some embodiments, the lung fibrosis is a sequela of a viral infection. In some embodiments, the subject can have any viral infection. In some embodiments, the viral infection is a respiratory viral infection. In some embodiments, any of the methods provided herein can be used in a subject that has a viral infection. In some embodiments, the viral infection is a coronavirus infection. In some embodiments, the viral infection is a SARS-related coronavirus infection. In some embodiments, the viral infection is a SARS-CoV-2 coronavirus infection. In some embodiments, the anti-Gal3 antibody or binding fragment thereof comprises or includes any one or more of the sequences described herein or provided in any one or more of FIG. 8, 9, 10, 11, 12, 13, 14, 15, 16, 17, or 18 or any one or more of a sequence that is at least 80%, 81%, 82%, 83%, 84%, 85%, 86%, 87%, 88%, 89%, 90%, 91%, 92%, 93%, 94%, 95%, 96%, 97%, 98%, 99% or greater identical thereto.

In some embodiments, a method of disrupting an interaction between Gal3 and a virus-associated host cell receptor is provided. The method comprises contacting the virus-associated host cell receptor with a protein. In some embodiments, the protein is an anti-Gal3 antibody or binding fragment thereof. In some embodiments, the anti-Gal3 antibody or binding fragment is specific for the N-terminal domain of Gal3, N-terminus of Gal3, or the TRD of Gal3. In some embodiments, the virus-associated host cell receptor is a SARS-CoV-2 associated host cell receptor. In some embodiments, the virus-associated host cell receptor is ACE2 or CD147. In some embodiments, the method provided herein can be used in a subject that has a viral infection. In some embodiments, the anti-Gal3 antibody or binding fragment thereof comprises or includes any one or more of the sequences described herein or provided in any one or more of FIG. 8, 9, 10, 11, 12, 13, 14, 15, 16, 17, or 18 or any one or more of a sequence that is at least 80%, 81%, 82%, 83%, 84%, 85%, 86%, 87%, 88%, 89%, 90%, 91%, 92%, 93%, 94%, 95%, 96%, 97%, 98%, 99% or greater identical thereto.

In some embodiments, a method of disrupting an interaction between Gal3 and a virus protein is provided. The method comprises contacting the viral protein with a protein. In some embodiments, the protein is an anti-Gal3 antibody or binding fragment thereof. In some embodiments, the anti-Gal3 antibody or binding fragment is specific for the N-terminal domain of Gal3, N-terminus of Gal3, or the TRD of Gal3. In some embodiments, the virus protein is a coronavirus protein. In some embodiments, the virus protein is a SARS-related coronavirus protein. In some embodiments, the virus protein is a SARS-CoV-2 coronavirus protein. In some embodiments, the virus protein is a SARS-CoV-2 spike (S) protein. In some embodiments, the anti-Gal3 antibody or binding fragment thereof comprises or includes any one or more of the sequences described herein or provided in any one or more of FIG. 8, 9, 10, 11, 12, 13, 14, 15, 16, 17, or 18 or any one or more of a sequence that is at least 80%, 81%, 82%, 83%, 84%, 85%, 86%, 87%, 88%, 89%, 90%, 91%, 92%, 93%, 94%, 95%, 96%, 97%, 98%, 99% or greater identical thereto.

In some embodiments, a method of treating a SARS-CoV-2 infection in a subject in need thereof is provided. The method comprises administering to the subject an effective amount of a protein. In some embodiments, the protein is an anti-Gal3 antibody or binding fragment thereof. In some embodiments, the anti-Gal3 antibody or binding fragment is specific for the N-terminal domain of Gal3, N-terminus of Gal3, or the TRD of Gal3. In some embodiments, the anti-Gal3 antibody or binding fragment thereof disrupts an interaction between Gal3 and a SARS-CoV-2-associated host cell receptor. In some embodiments, the SARS-CoV-2 associated host cell receptor is ACE2 or CD147. In some embodiments, the anti-Gal3 antibody or binding fragment thereof disrupts an interaction between Gal3 and a SARS-CoV-2 protein. In some embodiments, the SARS-CoV-2 protein is a SARS-CoV-2 S protein. In some embodiments, the anti-Gal3 antibody or binding fragment thereof comprises or includes any one or more of the sequences described herein or provided in any one or more of FIG. 8, 9, 10, 11, 12, 13, 14, 15, 16, 17, or 18 or any one or more of a sequence that is at least 80%, 81%, 82%, 83%, 84%, 85%, 86%, 87%, 88%, 89%, 90%, 91%, 92%, 93%, 94%, 95%, 96%, 97%, 98%, 99% or greater identical thereto.

In some embodiments, a method of treating a viral infection in a subject in need thereof is provided. The method comprises administering to the subject an effective amount of a protein. In some embodiments, the protein is an anti-Gal3 antibody or binding fragment thereof. In some embodiments, the anti-Gal3 antibody or binding fragment is specific for the N-terminal domain of Gal3, N-terminus of Gal3, or the TRD of Gal3. In some embodiments, the anti-Gal3 antibody or binding fragment thereof disrupts an interaction between Gal3 and a viral protein. In some embodiments, the viral infection is a coronavirus infection and the viral protein is a coronavirus protein. In some embodiments, the viral infection is a SARS-related coronavirus infection and the viral protein is a SARS-related coronavirus protein. In some embodiments, the viral infection is a SARS-CoV-2 viral infection and the viral protein is a SARS-CoV-2 S protein. In some embodiments, the anti-Gal3 antibody or binding fragment thereof comprises or includes any one or more of the sequences described herein or provided in any one or more of FIG. 8, 9, 10, 11, 12, 13, 14, 15, 16, 17, or 18 or any one or more of a sequence that is at least 80%, 81%, 82%, 83%, 84%, 85%, 86%, 87%, 88%, 89%, 90%, 91%, 92%, 93%, 94%, 95%, 96%, 97%, 98%, 99% or greater identical thereto.

In some embodiments, a method of treating a SARS-CoV-2 infection is provided. The method comprises administering to a subject an effective amount of a protein. In some embodiments, the protein is an anti-Gal3 antibody or binding fragment thereof. In some embodiments, the anti-Gal3 antibody or binding fragment is specific for the N-terminal domain of Gal3, N-terminus of Gal3, or the TRD of Gal3. The anti-Gal3 antibody or binding fragment thereof disrupts an interaction between Gal3 and a SARS-CoV-2 S protein. In some embodiments, the anti-Gal3 antibody is capable of binding to Gal3 on a SARS-CoV-2 virus, or Gal3 associated with a cell. In some embodiments, the Gal3 associated with a cell is a Gal3 expressed by the cell. In some embodiments, the Gal3 associated with a cell is a Gal3 bound to the cell surface. In some embodiments, the anti-Gal3 antibody or binding fragment thereof comprises or includes any one or more of the sequences described herein or provided in any one or more of FIG. 8, 9, 10, 11, 12, 13, 14, 15, 16, 17, 18 or any one or more of a sequence that is at least 80%, 81%, 82%, 83%, 84%, 85%, 86%, 87%, 88%, 89%, 90%, 91%, 92%, 93%, 94%, 95%, 96%, 97%, 98%, 99% or greater identical thereto.

In some embodiments, a method of preventing and/or reducing a viral spread is provided. The method comprises administering to a subject an effective amount of a protein. In some embodiments, the protein is an anti-Gal3 antibody or binding fragment thereof. In some embodiments, the anti-Gal3 antibody or binding fragment is specific for the N-terminal domain of Gal3, N-terminus of Gal3, or the TRD of Gal3. The anti-Gal3 antibody or binding fragment thereof disrupts an interaction between Gal3 and ACE2 and/or Gal3 and CD147. The method described herein can be applied to any subject that has a viral infection. In some embodiments, the anti-Gal3 antibody or binding fragment thereof comprises or includes any one or more of the sequences described herein or provided in any one or more of FIG. 8, 9, 10, 11, 12, 13, 14, 15, 16, 17, or 18 or any one or more of a sequence that is at least 80%, 81%, 82%, 83%, 84%, 85%, 86%, 87%, 88%, 89%, 90%, 91%, 92%, 93%, 94%, 95%, 96%, 97%, 98%, 99% or greater identical thereto.

In some embodiments, a method of reducing a risk that a virus can invade a cell is provided. The method comprises administering to a cell a protein. In some embodiments, the protein is an anti-Gal3 antibody or binding fragment thereof. In some embodiments, the anti-Gal3 antibody or binding fragment is specific for the N-terminal domain of Gal3, N-terminus of Gal3, or the TRD of Gal3. The anti-Gal3 antibody or binding fragment thereof disrupts an interaction between Gal3 and ACE2 and/or Gal3 and CD147. The method described herein can be applied to any cell and any virus. In some embodiments, the anti-Gal3 antibody or binding fragment thereof comprises or includes any one or more of the sequences described herein or provided in any one or more of FIG. 8, 9, 10, 11, 12, 13, 14, 15, 16, 17, or 18 or any one or more of a sequence that is at least 80%, 81%, 82%, 83%, 84%, 85%, 86%, 87%, 88%, 89%, 90%, 91%, 92%, 93%, 94%, 95%, 96%, 97%, 98%, 99% or greater identical thereto.

In some embodiments, a method of decreasing or inhibiting toxicity in a subject experiencing cytokine release syndrome (cytokine storm) or vulnerable to CRS is provided. The method comprises administering to the subject an effective amount of a protein. In some embodiments, the protein is an anti-Gal3 antibody or binding fragment thereof. In some embodiments, the anti-Gal3 antibody or binding fragment thereof is specific for the N-terminal domain of Gal3, N-terminus of Gal3, or the TRD of Gal3. In some embodiments, the CRS is a result of a bacterial infection, viral infection, fungal infection, protozoan infection, graft-versus-host disease, cytomegalovirus, Epstein-Barr virus, hemophagocytic lymphohistiocystosis (HLH), Epstein-Barr virus-associated HLH, sporadic HLH, macrophage activation syndrome (MAS), chronic arthritis, systemic Juvenile idiopathic Arthritis (sJIA), Still's Disease, Cryopyrin-associated Periodic Syndrome (CAPS), Familial Cold Autoinflammatory Syndrome (FCAS), Familial Cold Urticaria (FCU), Muckle-Well Syndrome (MWS), Chronic Infantile Neurological Cutaneous and Articular (CINCA) Syndrome, cryopyrinopathy comprising inherited or de novo gain of function mutations in the NLRP3 gene, a hereditary auto-inflammatory disorder, acute pancreatitis, severe burns, trauma, acute respiratory distress syndrome (ARDS), *Streptococcus, Pseudomonas*, influenza, bird flu, H5N1, H1N1, variola virus, coronavirus, severe acute respiratory syndrome (SARS), SARS-CoV-1, SARS-CoV-2, sepsis, gram-negative sepsis, Gram-positive toxins, malaria, Ebola virus, variola virus, systemic Gram-negative bacterial infection, bacteremia, Jarisch-Herxheimer syndrome, glycosylphosphatidylinositol (GPI), or lipopolysaccharide, or treatment with an immunotherapy comprising rituximab, obinutuzumab, alemtuzumab, brentuximab, dacetuzumab, nivolumab, theralizumab, oxaliplatin, lenalidomide, T-cell engager molecules, bi-specific T-cell engager (BiTE) molecules, or CAR T therapy. In some embodiments, the CRS is a result of sepsis. In some embodiments, the sepsis is bacterial sepsis, viral sepsis, fungal sepsis, or protozoan sepsis. In some embodiments, the CRS is a result of a viral infection. In some embodiments, the CRS is a result of a coronavirus infection. In some embodiments, the CRS is a result of a SARS-related coronavirus infection. In some embodiments, the CRS is a result of a SARS-CoV-2 coronavirus infection. In some embodiments, the anti-Gal3 antibody or binding fragment thereof comprises or includes any one or more of the sequences described herein or provided in any one or more of FIG. 8, 9, 10, 11, 12, 13, 14, 15, 16, 17, or 18 or any one or more of a sequence that is at least 80%, 81%, 82%, 83%, 84%, 85%, 86%, 87%, 88%, 89%, 90%, 91%, 92%, 93%, 94%, 95%, 96%, 97%, 98%, 99% or greater identical thereto.

In some embodiments, a method of decreasing or inhibiting inflammation in a subject in need thereof is provided. The method comprises administering to the subject an effective amount of a protein. In some embodiments, the protein is an anti-Gal3 antibody or binding fragment thereof. In some embodiments, the anti-Gal3 antibody or binding fragment thereof is specific for the N-terminus of Gal3, the N-terminal domain of Gal3, or the TRD of Gal3. In some embodiments, the inflammation in the subject is associated with neutrophil activation and/or migration. In some embodiments, administration of the effective amount of the anti-Gal3 antibody or binding fragment thereof decreases or inhibits neutrophil activation and/or migration in the subject. In some embodiments, administration of the effective amount of the anti-Gal3 antibody or binding fragment thereof decreases or inhibits cleavage of CD62L expressed by neutrophils and/or decreases or inhibits IL-8 production in the subject. In some embodiments, the method further comprise detecting a decrease in neutrophil CD62L cleavage and/or a decrease in IL-8 production in the subject after the administering step. In some embodiments, administration of the effective amount of the anti-Gal3 antibody or binding fragment thereof decreases the number of neutrophils in the subject. In some embodiments, the method further comprises detecting a decrease in the number of neutrophils in the subject after the administering step. In some embodiments, administration of the effective amount of the anti-Gal3 antibody or binding fragment thereof modulates (e.g. increases, decreases, or inhibits) expression of Gal3, myeloperoxidase (MPO), growth-related oncogene α (GROα)/keratinocytes-derived chemokine (KC), Ly6c1, INOS, IL-6, TNFα, IL-1B, Col1A1, aSMA, TGFβ, VEGFA, VEGFB, or any combination thereof, in the subject. In some embodiments, the method further comprises detecting a change (e.g. increase or decrease) in expression of Gal3, MPO, GROα/KC, Ly6c1, INOS, IL-6, TNFα, IL-1B, Col1A1, aSMA, TGFβ, VEGFA, VEGFB, or any combination thereof, in the subject after the administrating step. In some embodiments, administration of the effective amount of the anti-Gal3 antibody or binding fragment thereof decreases production of autoantibodies in the subject. In some embodiments, the autoantibodies are anti-nucleic acid autoantibodies. In some embodiments, the inflammation comprises lung inflammation. In some embodiments, the inflammation comprises COPD, pneumonitis, asthma, sarcoidosis, pulmonary fibrosis, histiocytosis, bronchiolitis obliterans, or any combination thereof. In some embodiments, the inflammation comprises an autoimmune disease. In some embodiments, the autoimmune disease comprises systemic lupus erythematosus (SLE), Graves' disease, rheumatoid arthritis, multiple sclerosis, Sjogren's syndrome, celiac disease, or any combination thereof. In some embodiments, the method further comprises detecting an improvement in the inflammation in the subject after the administrating step.

In some embodiments, a method of decreasing or inhibiting cleavage of CD62L, decreasing IL-8 production, and/or modulating (e.g. increasing or decreasing) expression of Gal3, MPO, GROα/KC, Ly6c1, INOS, IL-6, TNFα, IL-1B, Col1A1, aSMA, TGFβ, VEGFA, VEGFB, or any combination thereof, by a cell is disclosed. The method comprises contacting the cell with an anti-Gal3 antibody or binding fragment thereof, thereby decreasing or inhibiting cleavage of CD62L, decreasing IL-8 production, and/or modulating expression of Gal3, MPO, GROα/KC, Ly6c1, INOS, IL-6, TNFα, IL-1B, Col1A1, aSMA, TGFβ, VEGFA, VEGFB, or any combination thereof, by the cell. In some embodiments, the cell is an immune cell. In some embodiments, the cell is a neutrophil. In some embodiments, cleavage of CD62L is decreased by at least 60%, 65%, 70%, 75%, 80%, 85%, 90%, 95%, 96%, 97%, 98%, 99%, or 100%, IL-8 production is decreased by at least 1%, 2%, 3%, 4%, 5%, 10%, 15%, 20%, 25%, 30%, 35%, 40%, 45%, 50%, 55%, 60%, 65%, 70%, 75%, 80%, 85%, 90%, 95%, or 100%, TNFα expression is decreased by at least 10%, 15%, 20%, 25%, 30%, 35%, 40%, 45%, 50%, 55%, 60%, 65%, 70%, 75%, 80%, 85%, 90%, 95%, or 100%, and/or IL-6 expression is decreased by at least 10%, 15%, 20%, 25%, 30%, 35%, 40%, 45%, 50%, 55%, 60%, 65%, 70%, 75%, 80%, 85%, 90%, 95%, or 100%. In some embodiments, the decrease or inhibition of cleavage of CD62L, decrease in IL-8 production, and/or change (e.g. increase or decrease) in expression of Gal3, MPO, GROα/KC, Ly6c1, INOS, IL-6, TNFα, IL-1B, Col1A1, aSMA, TGFβ, VEGFA, VEGFB, or any combination thereof is determined by ELISA. In some embodiments, the anti-Gal3 antibody or binding fragment thereof comprises or includes any one or more of the sequences described herein or provided in any one or more of FIG. 8, 9, 10, 11, 12, 13, 14, 15, 16, 17, or 18 or any one or more of a sequence that is at least 80%, 81%, 82%, 83%, 84%, 85%, 86%, 87%, 88%, 89%, 90%, 91%, 92%, 93%, 94%, 95%, 96%, 97%, 98%, 99% or greater identical thereto.

In some embodiments, a method of detecting Gal3 in a sample is provided. The method comprises contacting the sample with a protein and detecting the presence or absence of Gal3. In some embodiments, the protein is an anti-Gal3 antibody or binding fragment thereof. In some embodiments, the anti-Gal3 antibody or binding fragment comprises a detectable moiety. In some embodiments, the anti-Gal3 antibody or binding fragment is specific for the N-terminal domain of Gal3, N-terminus of Gal3, or the TRD of Gal3. In some embodiments, the anti-Gal3 antibody or binding fragment thereof comprises or includes any one or more of the sequences described herein or provided in any one or more of FIG. 8, 9, 10, 11, 12, 13, 14, 15, 16, 17, or 18 or any one or more of a sequence that is at least 80%, 81%, 82%, 83%, 84%, 85%, 86%, 87%, 88%, 89%, 90%, 91%, 92%, 93%, 94%, 95%, 96%, 97%, 98%, 99% or greater identical thereto.

In some embodiments of the methods described herein, the anti-Gal3 antibody or binding fragment thereof binds to the N-terminus of Gal3, the N-terminal domain of Gal3, or the tandem repeat domain (TRD) of Gal3, or any combination thereof. In some embodiments of the methods described herein, the anti-Gal3 antibody or binding fragment thereof binds to Peptide 1 (ADNFSLHDALSGSGNPNPQG; SEQ ID NO: 3), Peptide 6 (GAYPGQAPPGAYPGAPGAYP; SEQ ID NO: 8), or Peptide 7 (AYPGAPGAYP-GAPAPGVYPG; SEQ ID NO: 9), or any combination thereof. In some embodiments of the methods described herein, the anti-Gal3 antibody or binding fragment thereof comprises (1) a light chain variable region comprising a $V_L$-CDR1, a $V_L$-CDR2, and a $V_L$-CDR3; and (2) a heavy chain variable region comprising a $V_H$-CDR1, a $V_H$-CDR2, and a $V_H$-CDR3, wherein the $V_L$-CDR1 comprises an amino acid sequence having at least 60%, at least 70%, at least 80%, at least 90%, or 100% sequence identity to any amino acid sequence according to SEQ ID NOs: 170-220, the $V_L$-CDR2 comprises an amino acid sequence having at least 60%, at least 70%, at least 80%, at least 90%, or 100% sequence identity to any amino acid sequence according to SEQ ID NOs: 221-247, the $V_L$-CDR3 comprises an amino acid sequence having at least 60%, at least 70%, at least 80%, at least 90%, or 100% sequence identity to any amino acid sequence according to SEQ ID NOs: 248-296, the $V_H$-CDR1 comprises an amino acid sequence having at least 60%, at least 70%, at least 80%, at least 90%, or 100% sequence identity to any amino acid sequence according to SEQ ID NOs: 27-70, the $V_H$-CDR2 comprises an amino acid sequence having at least 60%, at least 70%, at least 80%, at least 90%, or 100% sequence identity to any amino acid sequence according to SEQ ID NOs: 71-111, 826, and the $V_H$-CDR3 comprises an amino acid sequence having at least 60%, at least 70%, at least 80%, at least 90%, or 100% sequence identity to any amino acid sequence according to SEQ ID NOs: 112-169, 827. In some embodiments of the methods described herein, the anti-Gal3 antibody or binding fragment comprises a combination of a $V_L$-CDR1, a $V_L$-CDR2, a $V_L$-CDR3, a $V_H$-CDR1, a $V_H$-CDR2, and a $V_H$-CDR3 as illustrated in FIG. 14. In some embodiments of the methods described herein, the light chain variable region comprises a sequence having at least 80%, 81%, 82%, 83%, 84%, 85%, 86%, 87%, 88%, 89%, 90%, 91%, 92%, 93%, 94%, 95%, 96%, 97%, 98%, or 99% identity to the sequence selected from SEQ ID NOs: 374-449. In some embodiments of the methods described herein, the light chain variable region comprises the sequence selected from SEQ ID NOs: 374-449. In some embodiments of the methods described herein, the heavy chain variable region comprises a sequence having at least 80%, 81%, 82%, 83%, 84%, 85%, 86%, 87%, 88%, 89%, 90%, 91%, 92%, 93%, 94%, 95%, 96%, 97%, 98%, or 99% identity to the sequence selected from SEQ ID NOs: 297-373, 822, 828. In some embodiments of the methods described herein, the heavy chain variable region comprises the sequence selected from SEQ ID NOs: 297-373, 822, 828. In some embodiments of the methods described herein, the anti-Gal3 antibody or binding fragment thereof comprises a light chain, wherein the light chain comprises a sequence having at least 80%, 81%, 82%, 83%, 84%, 85%, 86%, 87%, 88%, 89%, 90%, 91%, 92%, 93%, 94%, 95%, 96%, 97%, 98%, or 99% identity to the sequence selected from SEQ ID NOs: 495-538, 830. In some embodiments of the methods described herein, the light chain comprises the sequence selected from SEQ ID NOs: 495-538, 830. In some embodiments of the methods described herein, the anti-Gal3 antibody or binding fragment thereof comprises a heavy chain, wherein the heavy chain comprises a sequence having at least 80%, 81%, 82%, 83%, 84%, 85%, 86%, 87%, 88%, 89%, 90%, 91%, 92%, 93%, 94%, 95%, 96%, 97%, 98%, or 99% identity to the sequence selected from SEQ ID NOs: 448-494, 829. In some embodiments of the methods described herein, the heavy chain comprises the sequence selected from SEQ ID NOs: 448-494, 829. In some embodiments of the methods described herein, the anti-Gal3 antibody or binding fragment thereof is selected from the group consisting of: TB001, TB006, 12G5.D7, 13A12.2E5, 14H10.2C9, 15F10.2D6, 19B5.2E6, 20D11.2C6, 20H5.A3, 23H9.2E4, 2D10.2B2, 3B11.2G2, 7D8.2D8, mIMT001, 4A11.2B5, 4A11.H1L1, 4A11.H4L2, 4G2.2G6, 6B3.2D3, 6H6.2D6, 9H2.2H10, 13G4.2F8, 13H12.2F8, 15G7.2A7, 19D9.2E5, 23B10.2B12, 24D12.2H9, F846C.1B2, F846C.1F5, F846C.1H12, F846C.1H5, F846C.2H3, F846TC.14A2, F846TC.14E4, F846TC.16B5, F846TC.7F10, F847C.10B9, F847C.11B1, F847C.12F12, F847C.26F5, F847C.4B10, F849C.8D10, F849C.8H3, 846.2B11, 846.4D5, 846T.1H2, 847.14H4, 846.2D4, 846.2F11, 846T.10B1, 846T.2E3, 846T.4C9, 846T.4E11, 846T.4F5, 846T.8D1, 847.10C9, 847.11D6, 847.15D12, 847.15F9, 847.15H11, 847.20H7, 847.21B11, 847.27B9, 847.28D1, 847.2B8, 847.3B3, 849.1D2, 849.2D7, 849.2F12, 849.4B2, 849.4F12, 849.4F2, 849.5C2, 849.8D12, F847C.21H6, 849.5H1, 847.23F11, 847.16D10, 847.13E2-mH0mL1, 847.13E2-mH0mL2, 847.12C4, 847.4D3, 2D10-VH0-VL0, or binding fragment thereof.

In some embodiments of the methods described herein, the anti-Gal3 antibody or binding fragment thereof is administered with one or more antiviral or anti-inflammatory therapeutics. In some embodiments, the one or more antiviral or anti-inflammatory therapeutics is selected from the group consisting of chloroquine, hydroxychloroquine, favipiravir, favilavir, remdesivir, tocilizumab, baricitinib, acalabrutinib, galidesivir, sarilumab, lopinavir, ritonavir, darunavir, ribavirin, dexamethasone, ciclesonide, convalescent plasma, interferon-α, pegylated interferon-α, and interferon alfa-2b, or any combination thereof.

In some embodiments, a use of an anti-Gal3 antibody or binding fragment thereof for the treatment of a viral infection is provided. In some embodiments, a use of an anti-Gal3 antibody or binding fragment thereof for the treatment of lung fibrosis is provided, where the lung fibrosis is a sequela of a viral infection. In some embodiments, the use of an anti-Gal3 antibody or binding fragment thereof for the treatment of CRS is provided. In some embodiments, the CRS is a result of a viral infection. In some embodiments, the CRS is a result of sepsis. In some embodiments, the CRS is a result of bacterial sepsis, viral sepsis, fungal sepsis, or protozoan sepsis. In some embodiments, the viral infection is a coronavirus infection. In some embodiments, the viral infection is a SARS-related coronavirus infection. In some embodiments, the viral infection is a SARS-CoV-2 coronavirus infection. In some embodiments, the anti-Gal3 antibody or binding fragment thereof binds to the N-terminus of Gal3. In some embodiments, the anti-Gal3 antibody or binding fragment thereof binds to the N-terminal domain of Gal3. In some embodiments, the anti-Gal3 antibody or binding fragment thereof binds to the tandem repeat domain of Gal3. In some embodiments, the anti-Gal3 antibody or binding fragment thereof binds to Peptide 1 (ADNFSLHDALSGSGNPNPQG; SEQ ID NO: 3), Peptide 6 (GAYPGQAPPGAYPGAPGAYP; SEQ ID NO: 8), or Peptide 7 (AYPGAPGAYPGAPAPGVYPG; SEQ ID NO: 9), or any combination thereof. In some embodiments, the anti-Gal3 antibody or binding fragment thereof comprises (1) a light chain variable region comprising a $V_L$-CDR1, a $V_L$-CDR2, and a $V_L$-CDR3; and (2) a heavy chain variable region comprising a $V_H$-CDR1, a $V_H$-CDR2, and a $V_H$-CDR3, wherein the $V_L$-CDR1 comprises an amino acid sequence having at least 60%, at least 70%, at least 80%, at least 90%, or 100% sequence identity to any amino acid sequence according to SEQ ID NOs: 170-220, the $V_L$-CDR2 comprises an amino acid sequence having at least 60%, at least 70%, at least 80%, at least 90%, or 100% sequence identity to any amino acid sequence according to SEQ ID NOs: 221-247, the $V_L$-CDR3 comprises an amino acid sequence having at least 60%, at least 70%, at least 80%, at least 90%, or 100% sequence identity to any amino acid sequence according to SEQ ID NOs: 248-296, the $V_H$-CDR1 comprises an amino acid sequence having at least 60%, at least 70%, at least 80%, at least 90%, or 100% sequence identity to any amino acid sequence according to SEQ ID NOs: 27-70, the $V_H$-CDR2 comprises an amino acid sequence having at least 60%, at least 70%, at least 80%, at least 90%, or 100% sequence identity to any amino acid sequence according to SEQ ID NOs: 71-111, 826, and the $V_H$-CDR3 comprises an amino acid sequence having at least 60%, at least 70%, at least 80%, at least 90%, or 100% sequence identity to any amino acid sequence according to SEQ ID NOs: 112-169, 827. In some embodiments, the anti-Gal3 antibody or binding fragment comprises a combination of a $V_L$-CDR1, a $V_L$-CDR2, a $V_L$-CDR3, a $V_H$-CDR1, a $V_H$-CDR2, and a $V_H$-CDR3 as illustrated in FIG. 14. In some embodiments, the light chain variable region comprises a sequence having at least 80%, 81%, 82%, 83%, 84%, 85%, 86%, 87%, 88%, 89%, 90%, 91%, 92%, 93%, 94%, 95%, 96%, 97%, 98%, or 99% identity to the sequence selected from SEQ ID NOs: 374-449. In some embodiments, the light chain variable region comprises the sequence selected from SEQ ID NOs: 374-449. In some embodiments, the heavy chain variable region comprises a sequence having at least 80%, 81%, 82%, 83%, 84%, 85%, 86%, 87%, 88%, 89%, 90%, 91%, 92%, 93%, 94%, 95%, 96%, 97%, 98%, or 99% identity to the sequence selected from SEQ ID NOs: 297-373, 822, 828. In some embodiments, the heavy chain variable region comprises the sequence selected from SEQ ID NOs: 297-373, 822, 828. In some embodiments, the anti-Gal3 antibody or binding fragment thereof comprises a light chain, wherein the light chain comprises a sequence having at least 80%, 81%, 82%, 83%, 84%, 85%, 86%, 87%, 88%, 89%, 90%, 91%, 92%, 93%, 94%, 95%, 96%, 97%, 98%, or 99% identity to the sequence selected from SEQ ID NOs: 495-538, 830. In some embodiments, the light chain comprises the sequence selected from SEQ ID NOs: 495-538, 830. In some embodiments, the anti-Gal3 antibody or binding fragment thereof comprises a heavy chain, wherein the heavy chain comprises a sequence having at least 80%, 81%, 82%, 83%, 84%, 85%, 86%, 87%, 88%, 89%, 90%, 91%, 92%, 93%, 94%, 95%, 96%, 97%, 98%, or 99% identity to the sequence selected from SEQ ID NOs: 448-494, 829. In some embodiments, the heavy chain comprises the sequence selected from SEQ ID NOs: 448-494, 829. In some embodiments, the anti-Gal3 antibody or binding fragment thereof is selected from the group consisting of: TB001, TB006, 12G5.D7, 13A12.2E5, 14H10.2C9, 15F10.2D6, 19B5.2E6, 20D11.2C6, 20H5.A3, 23H9.2E4, 2D10.2B2, 3B11.2G2, 7D8.2D8, mIMT001, 4A11.2B5, 4A11.H1L1, 4A11.H4L2, 4G2.2G6, 6B3.2D3, 6H6.2D6, 9H2.2H10, 13G4.2F8, 13H12.2F8, 15G7.2A7, 19D9.2E5, 23B10.2B12, 24D12.2H9, F846C.1B2, F846C.1F5, F846C.1H12, F846C.1H5, F846C.2H3, F846TC.14A2, F846TC.14E4, F846TC.16B5, F846TC.7F10, F847C.10B9, F847C.11B1, F847C.12F12, F847C.26F5, F847C.4B10, F849C.8D10, F849C.8H3, 846.2B11, 846.4D5, 846T.1H2, 847.14H4, 846.2D4, 846.2F11, 846T.10B1, 846T.2E3, 846T.4C9, 846T.4E11, 846T.4F5, 846T.8D1, 847.10C9, 847.11D6, 847.15D12, 847.15F9, 847.15H11, 847.20H7, 847.21B11, 847.27B9, 847.28D1, 847.2B8, 847.3B3, 849.1D2, 849.2D7, 849.2F12, 849.4B2, 849.4F12, 849.4F2, 849.5C2, 849.8D12, F847C.21H6, 849.5H1, 847.23F11, 847.16D10, 847.13E2-mH0mL1, 847.13E2-mH0mL2, 847.12C4, 847.4D3, 2D10-VH0-VL0, or binding fragment thereof. In some embodiments, the anti-Gal3 antibody or binding fragment thereof comprises or includes any one or more of the sequences described herein or provided in any one or more of FIG. 8, 9, 10, 11, 12, 13, 14, 15, 16, 17, or 18 or any one or more of a sequence that is at least 80%, 81%, 82%, 83%, 84%, 85%, 86%, 87%, 88%, 89%, 90%, 91%, 92%, 93%, 94%, 95%, 96%, 97%, 98%, 99% or greater identical thereto.

In some embodiments, any one or more of the antibodies or fragments thereof provided herein can be used for the treatment and/or prevention of any one or more of: a cytokine storm, influenza, bird flu, severe acute respiratory syndrome (SARS), Epstein-Barr virus-associated hemophagocytic lymphohistiocytosis (HLH), sepsis, gram-negative sepsis, malaria, an Ebola virus, a variola virus, a systemic Gram-negative bacterial infection, or Jarisch-Herxheimer syndrome, hemophagocytic lymphohistiocytosis (HLH), sporadic HLH, macrophage activation syndrome (MAS), chronic arthritis, systemic Juvenile idiopathic Arthritis (sJIA), Still's Disease, a Cryopyrin-associated Periodic Syndrome (CAPS), Familial Cold Auto-inflammatory Syndrome (FCAS), Familial Cold Urticaria (FCU), Muckle-Well Syndrome (MWS), Chronic Infantile Neurological Cutaneous and, Articular (CINCA) Syndrome, a cryopyrinopathy comprising inherited or de novo gain of function mutations in the NLRP3 gene, a hereditary autoinflammatory disorder, acute pancreatitis, a severe burns, a trauma, an acute respiratory distress syndrome, an immunotherapy, a monoclonal antibody therapy, secondary to drug use, is secondary to inhalation of toxins, a lipopolysaccharide (LPS), a Gram-positive toxins, fungal toxins, glycosylphosphatidylinositol (GPI), or modulation of RIG-1 gene expression.

Some embodiments described herein relate to pharmaceutical compositions that comprise, consist essentially of, or consist of an effective amount of an anti-Gal3 antibody or binding fragment described herein and a pharmaceutically acceptable carrier, excipient, or combination thereof. A pharmaceutical composition described herein is suitable for human and/or veterinary applications.

In some embodiments, any of the pharmaceutical antibody formulations disclosed herein are administered for therapeutic applications. In some embodiments, these can be used for the treatment of a disease such as a coronavirus infection or inflammation associated with said disease.

In some embodiments, the pharmaceutical antibody formulation administered for therapeutic applications comprises a therapeutically effective amount of an antibody, where the antibody comprises a $V_H$-CDR1 having the sequence of SEQ ID NO: 31, a $V_H$-CDR2 having the sequence of SEQ ID NO: 72, a $V_H$-CDR3 having the sequence of SEQ ID NO: 113, a $V_L$-CDR1 having the sequence of SEQ ID NO: 171, a $V_L$-CDR2 having the sequence of SEQ ID NO: 222; and a $V_L$-CDR3 having the sequence of SEQ ID NO: 249, where the antibody is present at an amount of 1 mg as a unit dose, L-histidine present at 20 mM, methionine present at 5 mM, NaCl present at 100 mM, polysorbate 80 present at 0.02% and where the pH is about 5.8.

In some embodiments, the pharmaceutical antibody formulation administered for therapeutic applications comprises a therapeutically effective amount of an antibody, where the antibody comprises a $V_H$-CDR1 having the sequence of SEQ ID NO: 31, a $V_H$-CDR2 having the sequence of SEQ ID NO: 72, a $V_H$-CDR3 having the sequence of SEQ ID NO: 113, a $V_L$-CDR1 having the sequence of SEQ ID NO: 171, a $V_L$-CDR2 having the sequence of SEQ ID NO: 222; and a $V_L$-CDR3 having the sequence of SEQ ID NO: 249, where the antibody is present at an amount of 5 mg as a unit dose, L-histidine present at 20 mM, methionine present at 5 mM, NaCl present at 100 mM, polysorbate 80 present at 0.02% and where the pH is about 5.8.

In some embodiments, the pharmaceutical antibody formulation administered for therapeutic applications comprises a therapeutically effective amount of an antibody, where the antibody comprises a $V_H$-CDR1 having the sequence of SEQ ID NO: 31, a $V_H$-CDR2 having the sequence of SEQ ID NO: 72, a $V_H$-CDR3 having the sequence of SEQ ID NO: 113, a $V_L$-CDR1 having the sequence of SEQ ID NO: 171, a $V_L$-CDR2 having the sequence of SEQ ID NO: 222; and a $V_L$-CDR3 having the sequence of SEQ ID NO: 249, where the antibody is present at an amount of 10 mg as a unit dose, L-histidine present at 20 mM, methionine present at 5 mM, NaCl present at 100 mM, polysorbate 80 present at 0.02% and where the pH is about 5.8.

In some embodiments, the pharmaceutical antibody formulation administered for therapeutic applications comprises a therapeutically effective amount of an antibody, where the antibody comprises a $V_H$-CDR1 having the sequence of SEQ ID NO: 31, a $V_H$-CDR2 having the sequence of SEQ ID NO: 72, a $V_H$-CDR3 having the sequence of SEQ ID NO: 113, a $V_L$-CDR1 having the sequence of SEQ ID NO: 171, a $V_L$-CDR2 having the sequence of SEQ ID NO: 222; and a $V_L$-CDR3 having the sequence of SEQ ID NO: 249, where the antibody is present at an amount of 20 mg as a unit dose, L-histidine present at 20 mM, methionine present at 5 mM, NaCl present at 100 mM, polysorbate 80 present at 0.02% and where the pH is about 5.8.

In some embodiments, the pharmaceutical antibody formulation administered for therapeutic applications comprises a therapeutically effective amount of an antibody, where the antibody comprises a $V_H$-CDR1 having the sequence of SEQ ID NO: 31, a $V_H$-CDR2 having the sequence of SEQ ID NO: 72, a $V_H$-CDR3 having the sequence of SEQ ID NO: 113, a $V_L$-CDR1 having the sequence of SEQ ID NO: 171, a $V_L$-CDR2 having the sequence of SEQ ID NO: 222; and a $V_L$-CDR3 having the sequence of SEQ ID NO: 249, where the antibody is present at an amount of 40 mg as a unit dose, L-histidine present at 20 mM, methionine present at 5 mM, NaCl present at 100 mM, polysorbate 80 present at 0.02% and where the pH is about 5.8.

In some embodiments, the pharmaceutical antibody formulation administered for therapeutic applications comprises a therapeutically effective amount of an antibody, where the antibody comprises a $V_H$-CDR1 having the sequence of SEQ ID NO: 31, a $V_H$-CDR2 having the sequence of SEQ ID NO: 72, a $V_H$-CDR3 having the sequence of SEQ ID NO: 113, a $V_L$-CDR1 having the sequence of SEQ ID NO: 171, a $V_L$-CDR2 having the sequence of SEQ ID NO: 222; and a $V_L$-CDR3 having the sequence of SEQ ID NO: 249, where the antibody is present at an amount of 50 mg as a unit dose, L-histidine present at 20 mM, methionine present at 5 mM, NaCl present at 100 mM, polysorbate 80 present at 0.02% and where the pH is about 5.8.

In some embodiments, the pharmaceutical antibody formulation administered for therapeutic applications comprises a therapeutically effective amount of an antibody, where the antibody comprises a VH region having a sequence at least 80%, 85%, 90%, 95%, 99%, or 100% identical to that of SEQ ID NO: 298 and a VL region having a sequence at least 80%, 85%, 90%, 95%, 99%, or 100% identical to that of SEQ ID NO: 375, where the antibody is present at an amount of 1 mg as a unit dose, L-histidine present at 20 mM, methionine present at 5 mM, NaCl present at 100 mM, polysorbate 80 present at 0.02% and where the pH is about 5.8.

In some embodiments, the pharmaceutical antibody formulation administered for therapeutic applications comprises a therapeutically effective amount of an antibody, where the antibody comprises a VH region having a sequence at least 80%, 85%, 90%, 95%, 99%, or 100% identical to that of SEQ ID NO: 298 and a VL region having a sequence at least 80%, 85%, 90%, 95%, 99%, or 100% identical to that of SEQ ID NO: 375, where the antibody is present at an amount of 5 mg as a unit dose, L-histidine present at 20 mM, methionine present at 5 mM, NaCl present at 100 mM, polysorbate 80 present at 0.02% and where the pH is about 5.8.

In some embodiments, the pharmaceutical antibody formulation administered for therapeutic applications comprises a therapeutically effective amount of an antibody, where the antibody comprises a VH region having a sequence at least 80%, 85%, 90%, 95%, 99%, or 100% identical to that of SEQ ID NO: 298 and a VL region having a sequence at least 80%, 85%, 90%, 95%, 99%, or 100% identical to that of SEQ ID NO: 375, where the antibody is present at an amount of 10 mg as a unit dose, L-histidine present at 20 mM, methionine present at 5 mM, NaCl present at 100 mM, polysorbate 80 present at 0.02% and where the pH is about 5.8.

In some embodiments, the pharmaceutical antibody formulation administered for therapeutic applications comprises a therapeutically effective amount of an antibody, where the antibody comprises a VH region having a sequence at least 80%, 85%, 90%, 95%, 99%, or 100% identical to that of SEQ ID NO: 298 and a VL region having a sequence at least 80%, 85%, 90%, 95%, 99%, or 100% identical to that of SEQ ID NO: 375, where the antibody is present at an amount of 20 mg as a unit dose, L-histidine present at 20 mM, methionine present at 5 mM, NaCl present at 100 mM, polysorbate 80 present at 0.02% and where the pH is about 5.8.

In some embodiments, the pharmaceutical antibody formulation administered for therapeutic applications comprises a therapeutically effective amount of an antibody, where the antibody comprises a VH region having a sequence at least 80%, 85%, 90%, 95%, 99%, or 100% identical to that of SEQ ID NO: 298 and a VL region having a sequence at least 80%, 85%, 90%, 95%, 99%, or 100% identical to that of SEQ ID NO: 375, where the antibody is present at an amount of 40 mg as a unit dose, L-histidine present at 20 mM, methionine present at 5 mM, NaCl present at 100 mM, polysorbate 80 present at 0.02% and where the pH is about 5.8.

In some embodiments, the pharmaceutical antibody formulation administered for therapeutic applications comprises a therapeutically effective amount of an antibody, where the antibody comprises a VH region having a sequence at least 80%, 85%, 90%, 95%, 99%, or 100% identical to that of SEQ ID NO: 298 and a VL region having a sequence at least 80%, 85%, 90%, 95%, 99%, or 100% identical to that of SEQ ID NO: 375, where the antibody is present at an amount of 50 mg as a unit dose, L-histidine present at 20 mM, methionine present at 5 mM, NaCl present at 100 mM, polysorbate 80 present at 0.02% and where the pH is about 5.8.

In some embodiments, the pharmaceutical antibody formulation is administered once per day, twice per day, three times per day or more. In some embodiments, the pharmaceutical antibody formulation is administered daily, every day, every alternate day, every ten days, five days a week, once a week, every other week, two weeks per month, three weeks per month, once a month, twice a month, three times per month, or more. The pharmaceutical antibody formulation is administered for at least 1 month, 2 months, 3 months, 4 months, 5 months, 6 months, 7 months, 8 months, 9 months, 10 months, 11 months, 12 months, 13 months, 14 months, 15 months, 16 months, 17 months, 18 months, 19 months, 20 months, 2 years, 3 years, or more.

As applied to any of the methods disclosed herein, in some embodiments, the pharmaceutical antibody formulation is administered enterally, orally, intranasally, parenterally, intracranially, subcutaneously, intramuscularly, intradermally, or intravenously, or any combination thereof. In some embodiments, the pharmaceutical antibody formulation is administered intravenously or subcutaneously. In some embodiments, the subject is a mammal. In some embodiments, the subject is a human.

In some embodiments, any of the pharmaceutical antibody compositions provided herein are used in a method for treating a coronavirus infection. In some embodiments, the methods comprise administering the pharmaceutical antibody formulation of any one of the preceding pharmaceutical antibody formulation claims or sterile vial claims to a subject in need of treatment for a coronavirus infection. In some embodiments, the methods further comprise detecting an improvement in the coronavirus infection in the subject after administration. In some embodiments, the pharmaceutical antibody formulation is administered daily, weekly, bi-weekly, or every 10 days. In some embodiments, the subject is administered 1 mg, 5 mg, 10 mg, 20 mg, 40 mg, or 50 mg of antibody as a unit dose, or any amount of antibody as a unit dose within a range defined by any two of the aforementioned amounts. In some embodiments, the subject is administered 1 mg of antibody as a unit dose. In some embodiments, the subject is administered 5 mg of antibody as a unit dose. In some embodiments, the subject is administered 10 mg of antibody as a unit dose. In some embodiments, the subject is administered 20 mg of antibody as a unit dose. In some embodiments, the subject is administered 40 mg of antibody as a unit dose. In some embodiments, the subject is administered 50 mg of antibody as a unit dose. In some embodiments, the unit dose is administered over the course of 10, 20, 30, 40, 50, 60, 70, 80, 90, 100, 120, 130, 140, 150, 160, 170, 180, 190, or 200 minutes, or any time within a range defined by any two of the aforementioned times. In some embodiments, the unit dose is administered over the course of 60 minutes. In some embodiments, the method further comprise identifying the subject in need of treatment for a coronavirus infection prior to administration, such as having the coronavirus infection or at risk of contracting the coronavirus infection. In some embodiments, the step of identifying the subject as in need of treatment for a coronavirus infection may be done according to the following inclusion criteria:

1) Willing and able to provide written informed consent prior to performing study or treatment procedures (or legally authorized representative able to provide consent on the patient's behalf).
2) Age≥18 years.
3) A positive SARS-CoV-2 infection confirmed by PCR test or an equivalent test≤3 days before treatment.
4) Patients with mild to moderate COVID-19 experience any of the following symptoms:
   a) Mild (without shortness of breath or dyspnea): fever, cough, sore throat, malaise, headache, muscle pain, gastrointestinal symptoms.
   b) Moderate: any symptom of mild illness, shortness of breath with excursion, clinically suggestive of moderate illness with COVID-19, such as respiratory rate≥20 breaths per minute, saturation of oxygen (SpO$_2$)>93% on room air at sea level, heart rate≥90 beats per minute.
5) At high risk for progressing to severe COVID-19 and/or hospitalization. High risk patients are defined as meeting at least one of the following criteria: have diabetes, have hypertension, have cancer, body mass index≥35, have chronic kidney disease, are ≥65 years of age, are ≥55 years of age and have cardiovascular disease such as hypertension or chronic obstructive pulmonary disease/other chronic respiratory disease.
6) Adequate organ function as evidenced by: hemoglobin>8 g/dL, absolute neutrophil count (ANC)>1.5×10$^9$/L, platelets>50×10$^9$/L, alanine aminotransferase (ALT) or aspartate aminotransferase (AST)<5.5× upper limit of normal (ULN), or creatinine clearance>50 mL/min using the Cockcroft-Gault formula for patients≥18 years of age and Schwartz formula for patients<18 years of age.

In some embodiments, the step of identifying the subject in need of treatment for a coronavirus infection comprises one or more of identifying a positive coronavirus infection by PCR test or equivalent test, identifying the subject as having symptoms of fever, cough, sore throat, malaise, headache, muscle pain, gastrointestinal symptoms, shortness of breath with excursion, respiratory rate≥20 breaths per minute, saturation of oxygen (SpO2)>93% on room air at sea level, heart rate≥90 beats per minute, diabetes, hypertension, cancer, chronic kidney disease, body mass index (BMI)≥35, ≥65 years of age, cardiovascular disease such as hypertension, chronic obstructive pulmonary disease or other chronic respiratory disease. In some embodiments, the treating step is to a patient that already has symptoms of a coronavirus infection. In some embodiments, the treating step is prophylactic. In some embodiments, the coronavirus infection is a SARS-CoV, MERS-CoV, or SARS-CoV-2 infection. In some embodiments, the antibody is administered for 10-18 months. In some embodiments, the antibody is administered intravenously. In some embodiments, the antibody is administered subcutaneously.

In some embodiments are disclosed methods for treating a coronavirus infection. In some embodiments, the methods comprise administering a pharmaceutical antibody formulation to a subject in need of treatment for a coronavirus infection, wherein the pharmaceutical antibody formulation comprises a therapeutically effective amount of an antibody, wherein the antibody comprises a $V_H$-CDR1 having the sequence of SEQ ID NO: 31, a $V_H$-CDR2 having the sequence of SEQ ID NO: 72, a $V_H$-CDR3 having the sequence of SEQ ID NO: 113, a $V_L$-CDR1 having the sequence of SEQ ID NO: 171, a $V_L$-CDR2 having the sequence of SEQ ID NO: 222; and a $V_L$-CDR3 having the sequence of SEQ ID NO: 249; histidine; methionine; NaCl; and polysorbate, wherein the formulation is at a pH between 5.3 and 6.3.

In some embodiments are disclosed methods for decreasing or inhibiting inflammation in a subject in need thereof. In some embodiments, the methods comprise administering a pharmaceutical antibody formulation to the subject in need thereof, wherein the pharmaceutical antibody formulation comprises a therapeutically effective amount of an antibody, wherein the antibody comprises a $V_H$-CDR1 having the sequence of SEQ ID NO: 31, a $V_H$-CDR2 having the sequence of SEQ ID NO: 72, a $V_H$-CDR3 having the sequence of SEQ ID NO: 113, a $V_L$-CDR1 having the sequence of SEQ ID NO: 171, a $V_L$-CDR2 having the sequence of SEQ ID NO: 222; and a $V_L$-CDR3 having the sequence of SEQ ID NO: 249; histidine; methionine; NaCl; and polysorbate, wherein the formulation is at a pH between 5.3 and 6.3.

Polynucleotides and Vectors for Antibody Production

In some embodiments, the present disclosure provides isolated nucleic acids encoding any of the anti-Gal3 antibodies or binding fragments thereof disclosed herein. In another embodiment, the present disclosure provides vectors comprising a nucleic acid sequence encoding any anti-Gal3 antibody or binding fragment thereof disclosed herein. In some embodiments, this disclosure provides isolated nucleic acids that encode a light-chain CDR and a heavy-chain CDR of an anti-Gal3 antibody or binding fragment thereof disclosed herein.

In some embodiments, nucleic acid sequences encoding for heavy chain variable regions are depicted in FIG. 29 (SEQ ID NOs: 539-620, 834). In some embodiments, nucleic acid sequences encoding for light chain variable regions are depicted in FIG. 30 (SEQ ID NOs: 621-702, 835). In some embodiments, nucleic acid sequences encoding for heavy chains are depicted in FIG. 31 (SEQ ID NO: 703-749, 836). In some embodiments, nucleic acid sequences encoding for light chains are depicted in FIG. 32 (SEQ ID NO: 750-796, 837).

The subject anti-Gal3 antibodies or binding fragments thereof can be prepared by recombinant DNA technology, synthetic chemistry techniques, or a combination thereof. For instance, sequences encoding the desired components of the anti-Gal3 antibodies, including light chain CDRs and heavy chain CDRs are typically assembled cloned into an expression vector using standard molecular techniques know in the art. These sequences may be assembled from other vectors encoding the desired protein sequence, from PCR-generated fragments using respective template nucleic acids, or by assembly of synthetic oligonucleotides encoding the desired sequences. Expression systems can be created by transfecting a suitable cell with an expressing vector which comprises an anti-Gal3 antibody of interest or binding fragment thereof.

Nucleotide sequences corresponding to various regions of light or heavy chains of an existing antibody can be readily obtained and sequenced using convention techniques including but not limited to hybridization, PCR, and DNA sequencing. Hybridoma cells that produce monoclonal antibodies serve as a preferred source of antibody nucleotide sequences. A vast number of hybridoma cells producing an array of monoclonal antibodies may be obtained from public or private repositories. The largest depository agent is American Type Culture Collection, which offers a diverse collection of well-characterized hybridoma cell lines. Alternatively, antibody nucleotides can be obtained from immunized or non-immunized rodents or humans, and form organs such as spleen and peripheral blood lymphocytes. Specific techniques applicable for extracting and synthesizing antibody nucleotides are described in Orlandi et al. (1989) *Proc. Natl. Acad. Sci. U.S.A.* 86: 3833-3837; Larrick et al. (1989) *Biochem. Biophys. Res. Commun.* 160:1250-1255; Sastry et al. (1989) *Proc. Natl. Acad. Sci., U.S.A.* 86: 5728-5732; and U.S. Pat. No. 5,969,108.

Polynucleotides encoding anti-Gal3 antibodies or binding fragments thereof can also be modified, for example, by substituting the coding sequence for human heavy and light chain constant regions in place of the homologous non-human sequences. In that manner, chimeric antibodies are prepared that retain the binding specificity of the original anti-Gal3 antibody or binding fragment thereof.

Anti-Gal3 Antibody Production

In some embodiments, anti-Gal3 antibodies or binding fragments thereof are raised by standard protocol by injecting a production animal with an antigenic composition. See, e.g., Harlow and Lane, Antibodies: A Laboratory Manual, Cold Spring Harbor Laboratory, 1988. When utilizing an entire protein, or a larger section of the protein, antibodies may be raised by immunizing the production animal with the protein and a suitable adjuvant (e.g., Freund's, Freund's complete, oil-in-water emulsions, etc.). When a smaller peptide is utilized, it is advantageous to conjugate the peptide with a larger molecule to make an immunostimulatory conjugate. Commonly utilized conjugate proteins that are commercially available for such use include bovine serum albumin (BSA) and keyhole limpet hemocyanin (KLH). In order to raise antibodies to particular epitopes, peptides derived from the full sequence may be utilized. Alternatively, in order to generate antibodies to relatively short peptide portions of the protein target, a superior immune response may be elicited if the polypeptide is joined to a carrier protein, such as ovalbumin, BSA or KLH.

Polyclonal or monoclonal anti-Gal3 antibodies or binding fragments thereof can be produced from animals which have been genetically altered to produce human immunoglobulins. A transgenic animal can be produced by initially producing a "knock-out" animal which does not produce the animal's natural antibodies, and stably transforming the animal with a human antibody locus (e.g., by the use of a human artificial chromosome). In such cases, only human antibodies are then made by the animal. Techniques for generating such animals, and deriving antibodies therefrom, are described in U.S. Pat. Nos. 6,162,963 and 6,150,584, each incorporated fully herein by reference in its entirety. Such antibodies can be referred to as human xenogenic antibodies.

Alternatively, anti-Gal3 antibodies or binding fragments thereof can be produced from phage libraries containing human variable regions. See U.S. Pat. No. 6,174,708, incorporated fully herein by reference in its entirety.

In some aspects of any of the embodiments disclosed herein, an anti-Gal3 antibody or binding fragment thereof is produced by a hybridoma.

For monoclonal anti-Gal3 antibodies, hybridomas may be formed by isolating the stimulated immune cells, such as those from the spleen of the inoculated animal. These cells can then be fused to immortalized cells, such as myeloma cells or transformed cells, which are capable of replicating indefinitely in cell culture, thereby producing an immortal, immunoglobulin-secreting cell line. The immortal cell line utilized can be selected to be deficient in enzymes necessary for the utilization of certain nutrients. Many such cell lines (such as myelomas) are known to those skilled in the art, and include, for example: thymidine kinase (TK) or hypoxanthine-guanine phosphoriboxyl transferase (HGPRT). These deficiencies allow selection for fused cells according to their ability to grow on, for example, hypoxanthine aminopterin-thymidine medium (HAT).

In addition, the anti-Gal3 antibody or binding fragment thereof may be produced by genetic engineering.

Anti-Gal3 antibodies or binding fragments thereof disclosed herein can have a reduced propensity to induce an undesired immune response in humans, for example, anaphylactic shock, and can also exhibit a reduced propensity for priming an immune response which would prevent repeated dosage with an antibody therapeutic or imaging agent (e.g., the human-anti-murine-antibody "HAMA" response). Such anti-Gal3 antibodies or binding fragments thereof include, but are not limited to, humanized, chimeric, or xenogenic human anti-Gal3 antibodies or binding fragments thereof.

Chimeric anti-Gal3 antibodies or binding fragments thereof can be made, for example, by recombinant means by combining the murine variable light and heavy chain regions (VK and VH), obtained from a murine (or other animal-derived) hybridoma clone, with the human constant light and heavy chain regions, in order to produce an antibody with predominantly human domains. The production of such chimeric antibodies is well known in the art and may be achieved by standard means (as described, e.g., in U.S. Pat. No. 5,624,659, incorporated fully herein by reference).

The term "humanized" as applies to a non-human (e.g. rodent or primate) antibodies are hybrid immunoglobulins, immunoglobulin chains or fragments thereof which contain minimal sequence derived from non-human immunoglobulin. For the most part, humanized antibodies are human immunoglobulins (recipient antibody) in which residues from a complementary determining region (CDR) of the recipient are replaced by residues from a CDR of a non-human species (donor antibody) such as mouse, rat, rabbit or primate having the desired specificity, affinity and capacity. In some embodiments, Fv framework region (FR) residues of the human immunoglobulin are replaced by corresponding non-human residues. Furthermore, the humanized antibody may comprise residues which are found neither in the recipient antibody nor in the imported CDR or framework sequences. These modifications are made to further refine and optimize antibody performance and minimize immunogenicity when introduced into a human body. In some examples, the humanized antibody will comprise substantially all of at least one, and typically two, variable domains, in which all or substantially all of the CDR regions correspond to those of a non-human immunoglobulin and all or substantially all of the FR regions are those of a human immunoglobulin sequence. The humanized antibody may also comprise at least a portion of an immunoglobulin constant region (Fc), typically that of a human immunoglobulin.

Humanized antibodies can be engineered to contain human-like immunoglobulin domains and incorporate only the complementarity-determining regions of the animal-derived antibody. This can be accomplished by carefully examining the sequence of the hyper-variable loops of the variable regions of a monoclonal antigen binding unit or monoclonal antibody and fitting them to the structure of a human antigen binding unit or human antibody chains. See, e.g., U.S. Pat. No. 6,187,287, incorporated fully herein by reference.

Methods for humanizing non-human antibodies are well known in the art. "Humanized" antibodies are antibodies in which at least part of the sequence has been altered from its initial form to render it more like human immunoglobulins. In some versions, the heavy (H) chain and light (L) chain constant (C) regions are replaced with human sequence. This can be a fusion polypeptide comprising a variable (V) region and a heterologous immunoglobulin C region. In some versions, the complementarity determining regions (CDRs) comprise non-human antibody sequences, while the V framework regions have also been converted to human sequences. See, for example, EP 0329400. In some versions, V regions are humanized by designing consensus sequences of human and mouse V regions and converting residues outside the CDRs that are different between the consensus sequences.

In principle, a framework sequence from a humanized antibody can serve as the template for CDR grafting; however, it has been demonstrated that straight CDR replacement into such a framework can lead to significant loss of binding affinity to the antigen. Glaser et al. (1992) *J. Immunol.* 149:2606; Tempest et al. (1992) *Biotechnology* 9:266; and Shalaby et al. (1992) *J. Exp. Med.* 17:217. The more homologous a human antibody (HuAb) is to the original murine antibody (muAb), the less likely that the human framework will introduce distortions into the murine CDRs that could reduce affinity. Based on a sequence homology search against an antibody sequence database, the HuAb IC4 provides good framework homology to muM4TS.22, although other highly homologous HuAbs would be suitable as well, especially kappa L chains from human subgroup I or H chains from human subgroup III. Kabat et al. (1987). Various computer programs such as ENCAD (Levitt et al. (1983) *J. Mol. Biol.* 168:595) are available to predict the ideal sequence for the V region. The disclosure thus encompasses HuAbs with different variable (V) regions. It is within the skill of one in the art to determine suitable V region sequences and to optimize these sequences. Methods for obtaining antibodies with reduced immunogenicity are also described in U.S. Pat. No. 5,270,202 and EP 699,755, each hereby incorporated by reference in its entirety.

Humanized antibodies can be prepared by a process of analysis of the parental sequences and various conceptual humanized products using three dimensional models of the parental and humanized sequences. Three dimensional immunoglobulin models are familiar to those skilled in the art. Computer programs are available which illustrate and display probable three-dimensional conformational structures of selected candidate immunoglobulin sequences. Inspection of these displays permits analysis of the likely role of the residues in the functioning of the candidate immunoglobulin sequence, i.e., the analysis of residues that influence the ability of the candidate immunoglobulin to bind its antigen. In this way, FR residues can be selected and combined from the consensus and import sequence so that the desired antibody characteristic, such as increased affinity for the target antigen(s), is achieved.

A process for humanization of subject antigen binding units can be as follows. The best-fit germline acceptor heavy and light chain variable regions are selected based on homology, canonical structure and physical properties of the human antibody germlines for grafting. Computer modeling of mVH/VL versus grafted hVH/VL is performed and prototype humanized antibody sequence is generated. If modeling indicated a need for framework back-mutations, second variant with indicated FW changes is generated. DNA fragments encoding the selected germline frameworks and murine CDRs are synthesized. The synthesized DNA fragments are subcloned into IgG expression vectors and sequences are confirmed by DNA sequencing. The humanized antibodies are expressed in cells, such as 293F and the proteins are tested, for example in MDM phagocytosis assays and antigen binding assays. The humanized antigen binding units are compared with parental antigen binding units in antigen binding affinity, for example, by FACS on cells expressing the target antigen. If the affinity is greater than 2-fold lower than parental antigen binding unit, a second round of humanized variants can be generated and tested as described above.

As noted above, an anti-Gal3 antibody or binding fragment thereof can be either "monovalent" or "multivalent." Whereas the former has one binding site per antigen-binding unit, the latter contains multiple binding sites capable of binding to more than one antigen of the same or different kind. Depending on the number of binding sites, antigen binding units may be bivalent (having two antigen-binding sites), trivalent (having three antigen-binding sites), tetravalent (having four antigen-binding sites), and so on.

Multivalent anti-Gal3 antibodies or binding fragments thereof can be further classified on the basis of their binding specificities. A "monospecific" anti-Gal3 antibody or binding fragment thereof is a molecule capable of binding to one or more antigens of the same kind. A "multispecific" anti-Gal3 antibody or binding fragment thereof is a molecule having binding specificities for at least two different antigens. While such molecules normally will only bind two distinct antigens (i.e. bispecific anti-Gal3 antibodies), antibodies with additional specificities such as trispecific antibodies are encompassed by this expression when used herein. This disclosure further provides multispecific anti-Gal3 antibodies. Multispecific anti-Gal3 antibodies or binding fragments thereof are multivalent molecules capable of binding to at least two distinct antigens, e.g., bispecific and trispecific molecules exhibiting binding specificities to two and three distinct antigens, respectively.

In some embodiments, the methods further provide for screening for or identifying antibodies capable of disrupting an interaction between Gal3 and a viral protein, such as a protein of the SARS-CoV-2 virus or other coronaviruses. In some embodiments, the viral protein is a SARS-CoV-2 S, E, M, or HE protein. In some embodiments, the method may comprise: (a) contacting Gal3 protein with an antibody that selectively binds to Gal3, thereby forming a Gal3-antibody complex; (b) contacting the Gal3-antibody complex with the viral protein; (c) removing unbound viral protein; and (d) detecting viral protein bound to the Gal3-antibody complex, wherein the antibody is capable of disrupting an interaction of Gal3 and the viral protein when the viral protein is not detected in (d). In some embodiments, the method comprises an immunoassay. In some embodiments, the immunoassay is an enzyme-linked immunosorbent assay (ELISA).

In some embodiments, the methods further provide for screening for or identifying antibodies capable of disrupting an interaction between Gal3 and a host receptor protein that a virus uses to enter the host cell. In some embodiments, the virus is a SARS-CoV-2 virus or other coronavirus. In some embodiments, the host receptor protein is ACE2 or CD147. In some embodiments, the method may comprise: (a) contacting Gal3 protein with an antibody that selectively binds to Gal3, thereby forming a Gal3-antibody complex; (b) contacting the Gal3-antibody complex with the host receptor protein; (c) removing unbound host receptor protein; and (d) detecting host receptor protein bound to the Gal3-antibody complex, wherein the antibody is capable of disrupting an interaction of Gal3 and the host receptor protein when the host receptor protein is not detected in (d). In some embodiments, the method comprises an immunoassay. In some embodiments, the immunoassay is an enzyme-linked immunosorbent assay (ELISA).

In some embodiments, the methods further provide for treating a disease or disorder in a subject in need thereof. In some embodiments, the disease or disorder is a viral infection. In some embodiments, the disease or disorder is a coronavirus infection. In some embodiments, the disease or disorder is a SARS-CoV-2 infection. In some embodiments, the disease or disorder is a sequela of a previous viral infection. In some embodiments, the methods may comprise: administering to the subject an anti-Gal3 antibody or binding fragment thereof, wherein the anti-Gal3 antibody or binding fragment thereof disrupts an interaction between Gal3 and a viral protein and/or a host receptor protein, thereby treating the infection. In some embodiments, the anti-Gal3 antibody or binding fragment thereof is specific for the N-terminal domain of Gal3, N-terminus of Gal3, or the TRD of Gal3. In some embodiments, the viral protein is a SARS-CoV-2 S, E, M, or HE protein. In some embodiments, the host receptor protein is ACE2 or CD147. In some embodiments, the anti-Gal3 antibody or binding fragment thereof is selected from the group consisting of: 6H6.2D6, 20H5.A3, 20D11.2C6, 4G2.2G6, 13H12.2F8, 19B5.2E6, 15G7.2A7, 23H9.2E4, 19D9.2E5, 2D10.2B2, 2D10-VH0-VL0, 4A11.2B5, 14H10.2C9, 3B11.2G2, 13A12.2E5, 7D8.2D8, 15F10.2D6, 23B10.2B12, 12G5.D7, 24D12.2H9, 6B3.2D3, 13G4.2F8, 9H2.2H10, IMT-001, IMT006, IMT006b, and IMT006c, or binding fragment thereof. In some embodiments, the sequelae include but are not limited to fibrosis, pulmonary fibrosis, pulmonary edema, cardiovascular disease, thrombosis, neurological disease, kidney disease, or liver disease. In some embodiments, the anti-Gal3 antibody or binding fragment thereof is administered in conjunction with another antiviral or anti-inflammatory therapy. Potential antiviral or anti-inflammatory therapeutics may include but are not limited to chloroquine, hydroxychloroquine, favipiravir, favilavir, remdesivir, tocilizumab, baricitinib, acalabrutinib, galidesivir, sarilumab, lopinavir, ritonavir, darunavir, ribavirin, dexamethasone, ciclesonide, convalescent plasma, interferon-α, pegylated interferon-α, or interferon alfa-2b, or any combination thereof.

Payload

In some embodiments, any anti-Gal3 antibody disclosed herein further comprises a payload. In some embodiments, the payload comprises a small molecule, a protein or functional fragment thereof, a peptide, or a nucleic acid polymer.

In some embodiments, the number of payloads conjugated to the anti-Gal3 antibody (e.g., the drug-to-antibody ratio or DAR) is about 1:1, one payload to one anti-Gal3 antibody. In some embodiments, the ratio of the payloads to the anti-Gal3 antibody is about 2:1, 3:1, 4:1, 5:1, 6:1, 7:1, 8:1, 9:1, 10:1, 11:1, 12:1, 13:1, 14:1, 15:1, 16:1, 17:1, 18:1, 19:1, or 20:1. In some embodiments, the ratio of the payloads to the anti-Gal3 antibody is about 2:1. In some embodiments, the ratio of the payloads to the anti-Gal3 antibody is about 3:1. In some embodiments, the ratio of the payloads to the anti-Gal3 antibody is about 4:1. In some embodiments, the ratio of the payloads to the anti-Gal3 antibody is about 6:1. In some embodiments, the ratio of the payloads to the anti-Gal3 antibody is about 8:1. In some embodiments, the ratio of the payloads to the anti-Gal3 antibody is about 12:1.

In some embodiment, the payload is a small molecule. In some embodiments, the small molecule is a cytotoxic payload. Exemplary cytotoxic payloads include, but are not limited to, microtubule disrupting agents, DNA modifying agents, or Akt inhibitors.

In some embodiments, the payload comprises a microtubule disrupting agent. Exemplary microtubule disrupting agents include, but are not limited to, 2-methoxyestradiol, auristatin, chalcones, colchicine, combretastatin, cryptophycin, dictyostatin, discodermolide, dolastain, eleutherobin, epothilone, halichondrin, laulimalide, maytansine, noscapinoid, paclitaxel, peloruside, phomopsin, podophyllotoxin, rhizoxin, spongistatin, taxane, tubulysin, vinca alkaloid, vinorelbine, or derivatives or analogs thereof.

In some embodiments, the maytansine is a maytansinoid. In some embodiments, the maytansinoid is DM1, DM4, or ansamitocin. In some embodiments, the maytansinoid is DM1. In some embodiments, the maytansinoid is DM4. In some embodiments, the maytansinoid is ansamitocin. In some embodiments, the maytansinoid is a maytansinid derivative or analog such as described in U.S. Pat. Nos. 5,208,020, 5,416,064, 7,276,497, and 6,716,821 or U.S. Publication Nos. 2013029900 and US20130323268.

In some embodiments, the payload is a dolastatin, or a derivative or analog thereof. In some embodiments, the dolastatin is dolastatin 10 or dolastatin 15, or derivatives or analogs thereof. In some embodiments, the dolastatin 10 analog is auristatin, soblidotin, symplostatin 1, or symplostatin 3. In some embodiments, the dolastatin 15 analog is cemadotin or tasidotin.

In some embodiments, the dolastatin 10 analog is auristatin or an auristatin derivative. In some embodiments, the auristatin or auristatin derivative is auristatin E (AE), auristatin F (AF), auristatin E5-benzoylvaleric acid ester (AEVB), monomethyl auristatin E (MMAE), monomethyl auristatin F (MMAF), or monomethyl auristatin D (MMAD), auristatin PE, or auristatin PYE. In some embodiments, the auristatin derivative is monomethyl auristatin E (MMAE). In some embodiments, the auristatin derivative is monomethyl auristatin F (MMAF). In some embodiments, the auristatin is an auristatin derivative or analog such as described in U.S. Pat. Nos. 6,884,869, 7,659,241, 7,498,298, 7,964,566, 7,750,116, 8,288,352, 8,703,714, and 8,871,720.

In some embodiments, the payload comprises a DNA modifying agent. In some embodiments, the DNA modifying agent comprises DNA cleavers, DNA intercalators, DNA transcription inhibitors, or DNA cross-linkers. In some embodiments, the DNA cleaver comprises bleomycin A2, calicheamicin, or derivatives or analogs thereof. In some embodiments, the DNA intercalator comprises doxorubicin, epirubicin, PNU-159682, duocarmycin, pyrrolobenzodiazepine, oligomycin C, daunorubicin, valrubicin, topotecan, or derivatives or analogs thereof. In some embodiments, the DNA transcription inhibitor comprises dactinomycin. In some embodiments, the DNA cross-linker comprises mitomycin C.

In some embodiments, the DNA modifying agent comprises amsacrine, anthracycline, camptothecin, doxorubicin, duocarmycin, enediyne, etoposide, indolinobenzodiazepine, netropsin, teniposide, or derivatives or analogs thereof.

In some embodiments, the anthracycline is doxorubicin, daunorubicin, epirubicin, idarubicin, mitomycin-C, dactinomycin, mithramycin, nemorubicin, pixantrone, sabarubicin, or valrubicin.

In some embodiments, the analog of camptothecin is topotecan, irinotecan, silatecan, cositecan, exatecan, lurtotecan, gimatecan, belotecan, rubitecan, or SN-38.

In some embodiments, the duocarmycin is duocarmycin A, duocarmycin B1, duocarmycin B2, duocarmycin C1, duocarmycin C2, duocarmycin D, duocarmycin SA, or CC-1065. In some embodiments, the enediyne is a calicheamicin, esperamicin, or dynemicin A.

In some embodiments, the pyrrolobenzodiazepine is anthramycin, abbeymycin, chicamycin, DC-81, mazethramycin, neothramycins A, neothramycin B, porothramycin, prothracarcin, sibanomicin (DC-102), sibiromycin, or tomaymycin. In some embodiments, the pyrrolobenzodiazepine is a tomaymycin derivative, such as described in U.S. Pat. Nos. 8,404,678 and 8,163,736. In some embodiments, the pyrrolobenzodiazepine is such as described in U.S. Pat. Nos. 8,426,402, 8,802,667, 8,809,320, 6,562,806, 6,608,192, 7,704,924, 7,067,511, 7,612,062, 7,244,724, 7,528,126, 7,049,311, 8,633,185, 8,501,934, and 8,697,688 and U.S. Publication No. US20140294868.

In some embodiments, the pyrrolobenzodiazepine is a pyrrolobenzodiazepine dimer. In some embodiments, the PBD dimer is a symmetric dimer. Examples of symmetric PBD dimers include, but are not limited to, SJG-136 (SG-2000), ZC-423 (SG2285), SJG-720, SJG-738, ZC-207 (SG2202), and DSB-120. In some embodiments, the PBD dimer is an unsymmetrical dimer. Examples of unsymmetrical PBD dimers include, but are not limited to, SJG-136 derivatives such as described in U.S. Pat. Nos. 8,697,688 and 9,242,013 and U.S. Publication No. 20140286970.

In some embodiments, the payload comprises an Akt inhibitor. In some embodiments, the Akt inhibitor comprises ipatasertib (GDC-0068) or derivatives thereof.

In some embodiments, the payload comprises a polymerase inhibitor, including, but not limited to polymerase II inhibitors such as a-amanitin, and poly(ADP-ribose) polymerase (PARP) inhibitors. Exemplary PARP inhibitors include, but are not limited to Iniparib (BSI 201), Talazoparib (BMN-673), Olaparib (AZD-2281), Olaparib, Rucaparib (AG014699, PF-01367338), Veliparib (ABT-888), CEP 9722, MK 4827, BGB-290, or 3-aminobenzamide.

In some embodiments, the payload comprises a detectable moiety. As used herein, a "detectable moiety" may comprise an atom, molecule, or compound that is useful in diagnosing, detecting or visualizing a location and/or quantity of a target molecule, cell, tissue, organ, and the like. Detectable moieties that can be used in accordance with the embodiments herein include, but are not limited to, radioactive substances (e.g. radioisotopes, radionuclides, radiolabels or radiotracers), dyes, contrast agents, fluorescent compounds or molecules, bioluminescent compounds or molecules, enzyme and enhancing agents (e.g. paramagnetic ions), or specific binding moieties such as streptavidin, avidin, or biotin. In addition, some nanoparticles, for example quantum dots or metal nanoparticles can be suitable for use as a detectable moiety.

Exemplary radioactive substances that can be used as detectable moieties in accordance with the embodiments herein include, but are not limited to, $^{18}$F, $^{18}$F-FAC, $^{32}$P, $^{33}$P, $^{45}$Ti, $^{47}$Sc, $^{52}$Fe, $^{59}$Fe, $^{62}$Cu, $^{64}$Cu, $^{67}$Cu, $^{67}$Ga, $^{68}$Ga, $^{75}$Sc, $^{77}$As, $^{86}$Y, $^{90}$Y, $^{89}$Sr, $^{89}$Zr, $^{94}$Tc, $^{94}$Tc, $^{99}$mTc, $^{99}$Mo, $^{105}$Pd, $^{105}$Rh, $^{111}$Ag, $^{111}$In, $^{123}$I, $^{124}$I, $^{125}$I, $^{131}$I, $^{142}$Pr, $^{143}$Pr, $^{149}$Pm, $^{153}$Sm, $^{154-158}$Gd, $^{161}$Tb, $^{166}$Dy, $^{166}$Ho, $^{169}$Er, $^{175}$Lu, $^{177}$Lu, $^{186}$Re, $^{188}$Re, $^{189}$Re, $^{194}$Ir, $^{198}$Au, $^{199}$Au, $^{211}$At, $^{211}$Pb, $^{212}$Bi, $^{212}$Pb, $^{213}$Bi, $^{223}$Ra and $^{225}$Ac. Exemplary paramagnetic ions substances that can be used as detectable markers include, but are not limited to ions of transition and lanthanide metals (e.g. metals having atomic numbers of 6 to 9, 21-29, 42, 43, 44, or 57-71). These metals include ions of Cr, V, Mn, Fe, Co, Ni, Cu, La, Ce, Pr, Nd, Pm, Sm, Eu, Gd, Tb, Dy, Ho, Er, Tm, Yb and Lu.

When the detectable marker is a radioactive metal or paramagnetic ion, in some embodiments, the marker can be reacted with a reagent having a long tail with one or more chelating groups attached to the long tail for binding these ions. The long tail can be a polymer such as a polylysine, polysaccharide, or other derivatized or derivatizable chain having pendant groups to which may be bound to a chelating group for binding the ions. Examples of chelating groups that may be used according to the embodiments herein include, but are not limited to, ethylenediaminetetraacetic acid (EDTA), diethylenetriaminepentaacetic acid (DTPA), DOTA, NOTA, NOGADA, NETA, deferoxamine (DfO), porphyrins, polyamines, crown ethers, bis-thiosemicarbazones, polyoximes, and like groups. The chelate can be linked to the antigen binding construct by a group which allows formation of a bond to the molecule with minimal loss of immunoreactivity and minimal aggregation and/or internal cross-linking. The same chelates, when complexed with non-radioactive metals, such as manganese, iron and gadolinium are useful for MRI, when used along with the antigen binding constructs and carriers described herein. Macrocyclic chelates such as NOTA, NOGADA, DOTA, and TETA are of use with a variety of metals and radiometals including, but not limited to, radionuclides of gallium, yttrium and copper, respectively. Other ring-type chelates such as macrocyclic polyethers, which are of interest for stably binding radionuclides, such as Radium-223 for RAIT may be used. In certain embodiments, chelating moieties may be used to attach a PET imaging agent, such as an Aluminum-18F complex, to a targeting molecule for use in PET analysis.

Exemplary contrast agents that can be used as detectable moieties in accordance with the embodiments of the disclosure include, but are not limited to, barium, diatrizoate, ethiodized oil, gallium citrate, iocarmic acid, iocetamic acid, iodamide, iodipamide, iodoxamic acid, iogulamide, iohexyl, iopamidol, iopanoic acid, ioprocemic acid, iosefamic acid, ioseric acid, iosulamide meglumine, iosemetic acid, iotasul, iotetric acid, iothalamic acid, iotroxic acid, ioxaglic acid, ioxotrizoic acid, ipodate, meglumine, metrizamide, metrizoate, propyliodone, thallous chloride, or combinations thereof.

Bioluminescent and fluorescent compounds or molecules and dyes that can be used as detectable moieties in accordance with the embodiments of the disclosure include, but are not limited to, allophycocyanin (APC), phycoerythrin (PE), fluorescein, fluorescein isothiocyanate (FITC), OREGON GREEN™, rhodamine, Texas red, tetrarhodimine isothiocynate (TRITC), Cy3, Cy5, and the like), fluorescent markers (e.g., green fluorescent protein (GFP) and the like), autoquenched fluorescent compounds that are activated by tumor-associated proteases, enzymes (e.g., luciferase, horseradish peroxidase, alkaline phosphatase, and the like), nanoparticles, biotin, digoxigenin or combinations thereof.

Enzymes that can be used as detectable moieties in accordance with the embodiments of the disclosure include, but are not limited to, horseradish peroxidase, alkaline phosphatase, acid phosphatase, glucose oxidase, β-galactosidase, β-glucoronidase or β-lactamase. Such enzymes may be used in combination with a chromogen, a fluorogenic compound or a luminogenic compound to generate a detectable signal.

In some embodiments, the payload is a nanoparticle. The term "nanoparticle" refers to a microscopic particle whose size is measured in nanometers, e.g., a particle with at least one dimension less than about 100 nm. Nanoparticles can be used as detectable substances because they are small enough to scatter visible light rather than absorb it. For example, gold nanoparticles possess significant visible light extinction properties and appear deep red to black in solution. As a result, compositions comprising antigen binding constructs conjugated to nanoparticles can be used for the in vivo imaging of T-cells in a subject. At the small end of the size range, nanoparticles are often referred to as clusters. Metal, dielectric, and semiconductor nanoparticles have been formed, as well as hybrid structures (e.g. core-shell nanoparticles). Nanospheres, nanorods, and nanocups are just a few of the shapes that have been grown. Semiconductor quantum dots and nanocrystals are examples of additional types of nanoparticles. Such nanoscale particles can be used as payloads to be conjugated to any one of the anti-Gal3 antibodies disclosed herein.

In some embodiments, the payload is an antimicrobial agent, a therapeutic agent, a prodrug, a peptide, a protein, an enzyme, a lipid, a biological response modifier, a pharmaceutical agent, a lymphokine, a heterologous antibody or fragment thereof, a detectable label, a polyethylene glycol (PEG) molecule, or a combination of two or more of the agents. In some embodiments, the payload comprises a neuroactive polypeptide, for example, a neurotrophic factors, endocrine factors, growth factors, paracrine factors, hypothalamic release factors, neurotransmitter polypeptides, polypeptide agonists for a receptor expressed by a CNS cell, polypeptides involved in lysosomal storage disease or any combination thereof. In some embodiments, the payload comprises an IL-1 receptor antagonist (IL-IRa), dalargin, an interferon-β, Glial-derived neurotrophic factor (GDNF), tumor necrosis factor receptor (TNFR), nerve growth factor (NGF), brain derived neurotrophic factor (BDNF), neurotrophin-4/5, neurotrophin (NT)-3, a neurturin, neuregulin, a netrin, ciliary neurotrophic factor (CNTF), stem cell factor (SCF), a semaphorin, hepatocyte growth factor (HGF), epidermal growth factor (EGF), transforming growth factor (TGF)-cx, TGF-B, vascular endothelial growth factor (VEGF), platelet-derived growth factor (PDGF), heregulin, artemin, persephin, interleukins, granulocyte-colony stimulating factor (CSF), granulocyte-macrophage-CSF, cardiotrophin-1, hedgehogs, leukemia inhibitory factor (LIF), midkine, pleiotrophin, erythropoietin (EPO), bone morphogenetic proteins (BMPs), netrins, saposins, any fragment thereof, or any combination thereof. In some embodiments, the payload is another antibody, or a heavy and/or light chain, or any other fragment thereof.

In some embodiments, the payload comprises a heterologous antibody or fragment thereof, for example, a heterologous antibody or fragment thereof specifically binds to one or more of beta-secretase 1 (BACE1), CD20, CD25, CD52, CD33, CTLA-4, tenascin, alpha-4 (a4) integrin, IL-12, IL-23, the p40 subunit of IL-12/IL-23, amyloid-13 (AI3), Huntingtin, nerve growth factor (NGF), epidermal growth factor receptor (EGFR/HER1), human epidermal growth factor receptor 2 (HER2/neu), vascular endothelial growth factor (VEGF), TrkA, TNF-a, TNF-13, a-synuclein Tau, apolipoprotein E4 (ApoE4), prion protein (PrP), leucine rich repeat kinase 2 (LRRK2), parkin, presenilin 1, presenilin 2, gamma secretase, death receptor 6 (DR6), amyloid precursor protein (APP), p75 neurotrophin receptor (p75NTR), caspase 6, a neurotrophic factor and/or a neurotrophic factor receptor.

In some embodiments, the payload comprises an immunomodulatory agent. Useful immunomodulatory agents include anti-hormones that block hormone action on tumors and immunosuppressive agents that suppress cytokine production, down-regulate self-antigen expression, or mask MHC antigens. Representative anti-hormones include anti-estrogens including, for example, tamoxifen, raloxifene, aromatase inhibiting 4(5)-imidazoles, 4-hydroxytamoxifen, trioxifene, keoxifene, LY 117018, onapristone, and toremifene; and anti-androgens such as flutamide, nilutamide, bicalutamide, leuprolide, and goserelin; and anti-adrenal agents. Illustrative immunosuppressive agents include, but are not limited to 2-amino-6-aryl-5-substituted pyrimidines, azathioprine, cyclophosphamide, bromocryptine, danazol, dapsone, glutaraldehyde, anti-idiotypic antibodies for MHC antigens and MHC fragments, cyclosporin A, steroids such as glucocorticosteroids, streptokinase, or rapamycin.

In some embodiments, the payload comprises an immune modulator. Exemplary immune modulators include, but are not limited to, gancyclovir, etanercept, tacrolimus, sirolimus, voclosporin, cyclosporine, rapamycin, cyclophosphamide, azathioprine, mycophenolate mofetil, methotrexate, glucocorticoid and its analogs, xanthines, stem cell growth factors, lymphotoxins, hematopoietic factors, tumor necrosis factor (TNF) (e.g., TNFα), interleukins (e.g., interleukin-1 (IL-1), IL-2, IL-3, IL-6, IL-10, IL-12, IL-18, and IL-21), colony stimulating factors (e.g., granulocyte-colony stimulating factor (G-CSF) and granulocyte macrophage-colony stimulating factor (GM-CSF)), interferons (e.g., interferons-alpha, interferon-beta, interferon-gamma), the stem cell growth factor designated "S1 factor," erythropoietin and thrombopoietin, or a combination thereof.

In some embodiments, the payload comprises an immunotoxin. Immunotoxins include, but are not limited to, ricin, radionuclides, pokeweed antiviral protein, *Pseudomonas* exotoxin A, diphtheria toxin, ricin A chain, fungal toxins such as restrictocin and phospholipase enzymes. See, generally, "Chimeric Toxins," Olsnes and Pihl, *Pharmac. Ther.* 15:355-381 (1981); and "Monoclonal Antibodies for Cancer Detection and Therapy," eds. Baldwin and Byers, pp. 159-179, 224-266, Academic Press (1985).

In some embodiments, the payload comprises a nucleic acid polymer. In such instances, the nucleic acid polymer comprises short interfering nucleic acid (siNA), short interfering RNA (siRNA), double-stranded RNA (dsRNA), micro-RNA (miRNA), short hairpin RNA (shRNA), an antisense oligonucleotide. In other instances, the nucleic acid polymer comprises an mRNA, encoding, e.g., a cytotoxic protein or peptide or an apoptotic triggering protein or peptide. Exemplary cytotoxic proteins or peptides include a bacterial cytotoxin such as an alpha-pore forming toxin (e.g., cytolysin A from *E. coli*), a beta-pore-forming toxin (e.g., α-Hemolysin, PVL—panton Valentine leukocidin, aerolysin, clostridial Epsilon-toxin, *Clostridium perfringens* enterotoxin), binary toxins (anthrax toxin, edema toxin, *C. botulinum* C2 toxin, C spirofome toxin, *C. perfringens* iota toxin, *C. difficile* cyto-lethal toxins (A and B)), prion, parasporin, a cholesterol-dependent cytolysins (e.g., pneumolysin), a small pore-forming toxin (e.g., Gramicidin A), a cyanotoxin (e.g., microcystins, nodularins), a hemotoxin, a neurotoxin (e.g., botulinum neurotoxin), a cytotoxin, cholera toxin, diphtheria toxin, *Pseudomonas* exotoxin A, tetanus toxin, or an immunotoxin (idarubicin, ricin A, CRM9, Pokeweed antiviral protein, DT). Exemplary apoptotic triggering proteins or peptides include apoptotic protease activating factor-1 (Apaf-1), cytochrome-c, caspase initiator proteins (CASP2, CASP8, CASP9, CASP10), apoptosis inducing factor (AIF), p53, p73, p63, Bcl-2, Bax, granzyme B, poly-ADP ribose polymerase (PARP), and P 21-activated kinase 2 (PAK2). In additional instances, the nucleic acid polymer comprises a nucleic acid decoy. In some embodiments, the nucleic acid decoy is a mimic of protein-binding nucleic acids such as RNA-based protein-binding mimics. Exemplary nucleic acid decoys include transactivating region (TAR) decoy and Rev response element (RRE) decoy.

In some embodiments, the payload is an aptamer. Aptamers are small oligonucleotide or peptide molecules that bind to specific target molecules. Exemplary nucleic acid aptamers include DNA aptamers, RNA aptamers, or XNA aptamers which are RNA and/or DNA aptamers comprising one or more unnatural nucleotides. Exemplary nucleic acid aptamers include ARC19499 (Archemix Corp.), REG1 (Regado Biosciences), and ARC1905 (Ophthotech).

Nucleic acids in accordance with the embodiments described herein optionally include naturally occurring nucleic acids, or one or more nucleotide analogs or have a structure that otherwise differs from that of a naturally occurring nucleic acid. For example, 2'-modifications include halo, alkoxy, and allyloxy groups. In some embodiments, the 2'-OH group is replaced by a group selected from H, OR, R, halo, SH, SR, $NH_2$, NHR, $NR_2$ or CN, wherein R is $C_1$-$C_6$ alkyl, alkenyl, or alkynyl, and halo is F, Cl, Br, or I. Examples of modified linkages include phosphorothioate and 5'-N-phosphoramidite linkages.

Nucleic acids having a variety of different nucleotide analogs, modified backbones, or non-naturally occurring internucleoside linkages are utilized in accordance with the embodiments described herein. In some embodiments, nucleic acids include natural nucleosides (i.e., adenosine, thymidine, guanosine, cytidine, uridine, deoxyadenosine, deoxythymidine, deoxyguanosine, and deoxycytidine) or modified nucleosides. Examples of modified nucleotides include base modified nucleoside (e.g., aracytidine, inosine, isoguanosine, nebularine, pseudouridine, 2,6-diaminopurine, 2-aminopurine, 2-thiothymidine, 3-deaza-5-azacytidine, 2'-deoxyuridine, 3-nitorpyrrole, 4-methylindole, 4-thiouridine, 4-thiothymidine, 2-aminoadenosine, 2-thiothymidine, 2-thiouridine, 5-bromocytidine, 5-iodouridine, inosine, 6-azauridine, 6-chloropurine, 7-deazaadenosine, 7-deazaguanosine, 8-azaadenosine, 8-azidoadenosine, benzimidazole, M1-methyladenosine, pyrrolo-pyrimidine, 2-amino-6-chloropurine, 3-methyl adenosine, 5-propynylcytidine, 5-propynyluridine, 5-bromouridine, 5-fluorouridine, 5-methylcytidine, 7-deazaadenosine, 7-deazaguanosine, 8-oxoadenosine, 8-oxoguanosine, O(6)-methylguanine, and 2-thiocytidine), chemically or biologically modified bases (e.g., methylated bases), modified sugars (e.g., 2'-fluororibose, 2'-aminoribose, 2'-azidoribose, 2'-O-methylribose, L-enantiomeric nucleosides arabinose, and hexose), modified phosphate groups (e.g., phosphorothioates and 5'-N-phosphoramidite linkages), and combinations thereof. Natural and modified nucleotide monomers for the chemical synthesis of nucleic acids are readily available. In some embodiments, nucleic acids comprising such modifications display enhanced properties relative to nucleic acids consisting only of naturally occurring nucleotides. In some embodiments, nucleic acid modifications described herein are utilized to reduce and/or prevent digestion by nucleases (e.g. exonucleases, endonucleases, etc.). For example, the structure of a nucleic acid may be stabilized by including nucleotide analogs at the 3' end of one or both strands order to reduce digestion.

Different nucleotide modifications and/or backbone structures may exist at various positions in the nucleic acid. Such modifications include morpholinos, peptide nucleic acids (PNAs), methylphosphonate nucleotides, thiolphosphonate nucleotides, 2'-fluoro N3-P5'-phosphoramidites, 1', 5'-anhydrohexitol nucleic acids (HNAs), or a combination thereof.

Any of the anti-Gal3 antibodies disclosed herein may be conjugated to one or more (e.g. 1, 2, 3, 4, 5, 6, 7, 8, 9, or 10, or more) payloads described herein.

Conjugation Chemistry

In some embodiments, the payload is conjugated to an anti-Gal3 antibody described herein by a native ligation. In some embodiments, the conjugation is as described in: Dawson, et al. "Synthesis of proteins by native chemical ligation," *Science* 1994, 266, 776-779; Dawson, et al. "Modulation of Reactivity in Native Chemical Ligation through the Use of Thiol Additives," *J. Am. Chem. Soc.* 1997, 119, 4325-4329; Hackeng, et al. "Protein synthesis by native chemical ligation: Expanded scope by using straightforward methodology.," *Proc. Natl. Acad. Sci. USA* 1999, 96, 10068-10073; or Wu, et al. "Building complex glycopeptides: Development of a cysteine-free native chemical ligation protocol," *Angew. Chem. Int. Ed.* 2006, 45, 4116-4125. In some embodiments, the conjugation is as described in U.S. Pat. No. 8,936,910.

In some embodiments, the payload is conjugated to an anti-Gal3 antibody described herein by a site-directed method utilizing a "traceless" coupling technology (Philochem). In some embodiments, the "traceless" coupling technology utilizes an N-terminal 1,2-aminothiol group on the binding moiety which is then conjugated with a polynucleic acid molecule containing an aldehyde group. (see Casi et al., "Site-specific traceless coupling of potent cytotoxic drugs to recombinant antibodies for pharmacodelivery," *JACS* 134(13): 5887-5892 (2012))

In some embodiments, the payload is conjugated to an anti-Gal3 antibody described herein by a site-directed method utilizing an unnatural amino acid incorporated into the binding moiety. In some embodiments, the unnatural amino acid comprises p-acetylphenylalanine (pAcPhe). In some embodiments, the keto group of pAcPhe is selectively coupled to an alkoxy-amine derivatived conjugating moiety to form an oxime bond. (see Axup et al., "Synthesis of site-specific antibody-drug conjugates using unnatural amino acids," *PNAS* 109(40): 16101-16106 (2012)).

In some embodiments, the payload is conjugated to an anti-Gal3 antibody described herein by a site-directed method utilizing an enzyme-catalyzed process. In some embodiments, the site-directed method utilizes SMARTag™ technology (Redwood). In some embodiments, the SMARTag™ technology comprises generation of a formylglycine (FGly) residue from cysteine by formylglycine-generating enzyme (FGE) through an oxidation process under the presence of an aldehyde tag and the subsequent conjugation of FGly to an alkylhydraine-functionalized polynucleic acid molecule via hydrazino-Pictet-Spengler (HIPS) ligation. (see Wu et al., "Site-specific chemical modification of recombinant proteins produced in mammalian cells by using the genetically encoded aldehyde tag," *PNAS* 106(9): 3000-3005 (2009); Agarwal, et al., "A Pictet-Spengler ligation for protein chemical modification," *PNAS* 110(1): 46-51 (2013)).

In some embodiments, the enzyme-catalyzed process comprises microbial transglutaminase (mTG). In some embodiments, the payload is conjugated to the anti-Gal3 antibody utilizing a microbial transglutaminase catalyzed process. In some embodiments, mTG catalyzes the formation of a covalent bond between the amide side chain of a glutamine within the recognition sequence and a primary amine of a functionalized polynucleic acid molecule. In some embodiments, mTG is produced from *Streptomyces mobarensis*. (see Strop et al., "Location matters: site of conjugation modulates stability and pharmacokinetics of antibody drug conjugates," *Chemistry and Biology* 20(2) 161-167 (2013)).

In some embodiments, the payload is conjugated to an anti-Gal3 antibody by a method as described in PCT Publication No. WO2014/140317, which utilizes a sequence-specific transpeptidase and is hereby expressly incorporated by reference in its entirety.

In some embodiments, the payload is conjugated to an anti-Gal3 antibody described herein by a method as described in U.S. Patent Publication Nos. 2015/0105539 and 2015/0105540.

Linker

In some embodiments, a linker described herein comprises a natural or synthetic polymer, consisting of long chains of branched or unbranched monomers, and/or cross-linked network of monomers in two or three dimensions. In some embodiments, the linker includes a polysaccharide, lignin, rubber, or polyalkylene oxide (e.g., polyethylene glycol).

In some embodiments, the linker includes, but is not limited to, alpha-, omega-dihydroxylpolyethyleneglycol, biodegradable lactone-based polymer, e.g. polyacrylic acid, polylactide acid (PLA), poly(glycolic acid) (PGA), polypropylene, polystyrene, polyolefin, polyamide, polycyanoacrylate, polyimide, polyethylenterephthalat (PET, PETG), polyethylene terephthalate (PETE), polytetramethylene glycol (PTG), or polyurethane as well as mixtures thereof. As used herein, a mixture refers to the use of different polymers within the same compound as well as in reference to block copolymers. In some embodiments, block copolymers are polymers wherein at least one section of a polymer is built up from monomers of another polymer. In some embodiments, the linker comprises polyalkylene oxide. In some embodiments, the linker comprises PEG. In some embodiments, the linker comprises polyethylene imide (PEI) or hydroxy ethyl starch (HES).

In some embodiments, the polyalkylene oxide (e.g., PEG) is a polydisperse or monodisperse compound. In some embodiments, polydisperse material comprises disperse distribution of different molecular weight of the material, characterized by mean weight (weight average) size and dispersity. In some embodiments, the monodisperse PEG comprises one size of molecules. In some embodiments, the linker is poly- or monodispersed polyalkylene oxide (e.g., PEG) and the indicated molecular weight represents an average of the molecular weight of the polyalkylene oxide, e.g., PEG, molecules.

In some embodiments, the linker comprises a polyalkylene oxide (e.g., PEG) and the molecular weight of the polyalkylene oxide (e.g., PEG) is about 200, 300, 400, 500, 600, 700, 800, 900, 1000, 1100, 1200, 1300, 1400, 1450, 1500, 1600, 1700, 1800, 1900, 2000, 2100, 2200, 2300, 2400, 2500, 2600, 2700, 2800, 2900, 3000, 3250, 3350, 3500, 3750, 4000, 4250, 4500, 4600, 4750, 5000, 5500, 6000, 6500, 7000, 7500, 8000, 10,000, 12,000, 20,000, 35,000, 40,000, 50,000, 60,000, or 100,000 Da.

In some embodiments, the polyalkylene oxide (e.g., PEG) is a discrete PEG, in which the discrete PEG is a polymeric PEG comprising more than one repeating ethylene oxide unit. In some embodiments, a discrete PEG (dPEG) comprises from 2 to 60, from 2 to 50, or from 2 to 48 repeating ethylene oxide units. In some embodiments, a dPEG comprises about 2, 3, 4, 5, 6, 7, 8, 9, 10, 11, 12, 13, 14, 15, 16, 17, 18, 19, 20, 22, 24, 26, 28, 30, 35, 40, 42, 48, 50 or more repeating ethylene oxide units. In some embodiments, a dPEG comprises about 2 or more repeating ethylene oxide units. In some embodiments, a dPEG is synthesized as a single molecular weight compound from pure (e.g., about 95%, 98%, 99%, or 99.5%) starting material in a step-wise fashion. In some embodiments, a dPEG has a specific molecular weight, rather than an average molecular weight.

In some embodiments, the linker is a discrete PEG, optionally comprising from 2 to 60, from 2 to 50, or from 2 to 48 repeating ethylene oxide units. In some embodiments, the linker comprises a dPEG comprising about 2, 3, 4, 5, 6, 7, 8, 9, 10, 11, 12, 13, 14, 15, 16, 17, 18, 19, 20, 22, 24, 26, 28, 30, 35, 40, 42, 48, 50 or more repeating ethylene oxide units.

In some embodiments, the linker is a polypeptide linker. In some embodiments, the polypeptide linker comprises at least 2, 3, 4, 5, 6, 7, 8, 10, 15, 20, 25, 30, 35, 40, 45, 50, 60, 70, 80, 90, 100, or more amino acid residues. In some embodiments, the polypeptide linker comprises at least 2, 3, 4, 5, 6, 7, 8, or more amino acid residues. In some embodiments, the polypeptide linker comprises at most 2, 3, 4, 5, 6, 7, 8, or less amino acid residues. In some embodiments, the polypeptide linker is a cleavable polypeptide linker (e.g., either enzymatically or chemically). In some embodiments, the polypeptide linker is a non-cleavable polypeptide linker. In some embodiments, the polypeptide linker comprises Val-Cit (valine-citrulline), Gly-Gly-Phe-Gly (SEQ ID NO: 841), Phe-Lys, Val-Lys, Gly-Phe-Lys, Phe-Phe-Lys, Ala-Lys, Val-Arg, Phe-Cit, Phe-Arg, Leu-Cit, Ile-Cit, Trp-Cit, Phe-Ala, Ala-Leu-Ala-Leu (SEQ ID NO: 842), or Gly-Phe-Leu-Gly (SEQ ID NO: 843). In some embodiments, the polypeptide linker comprises a peptide such as: Val-Cit (valine-citrulline), Gly-Gly-Phe-Gly (SEQ ID NO: 841), Phe-Lys, Val-Lys, Gly-Phe-Lys, Phe-Phe-Lys, Ala-Lys, Val-Arg, Phe-Cit, Phe-Arg, Leu-Cit, Ile-Cit, Trp-Cit, Phe-Ala, Ala-Leu-Ala-Leu (SEQ ID NO: 842), or Gly-Phe-Leu-Gly (SEQ ID NO: 843). In some embodiments, the polypeptide linker comprises L-amino acids, D-amino acids, or a mixture of both L- and D-amino acids.

In some embodiments, the linker comprises a homobifunctional linker. Exemplary homobifunctional linkers include, but are not limited to, Lomant's reagent dithiobis (succinimidylpropionate) DSP, 3'3'-dithiobis(sulfosuccinimidyl proprionate (DTSSP), disuccinimidyl suberate (DSS), bis(sulfosuccinimidyl)suberate (BS), disuccinimidyl tartrate (DST), disulfosuccinimidyl tartrate (sulfo DST), ethylene glycobis(succinimidylsuccinate) (EGS), disuccinimidyl glutarate (DSG), N,N'-disuccinimidyl carbonate (DSC), dimethyl adipimidate (DMA), dimethyl pimelimidate (DMP), dimethyl suberimidate (DMS), dimethyl-3,3'-dithiobispropionimidate (DTBP), 1,4-di-3'-(2'-pyridyldithio)propionamido)butane (DPDPB), bismaleimidohexane (BMH), aryl halide-containing compound (DFDNB), such as e.g. 1,5-difluoro-2,4-dinitrobenzene or 1,3-difluoro-4,6-dinitrobenzene, 4,4'-difluoro-3,3'-dinitrophenylsulfone (DFDNPS), bis-[β-(4-azidosalicylamido)ethyl]disulfide (BASED), formaldehyde, glutaraldehyde, 1,4-butanediol diglycidyl ether, adipic acid dihydrazide, carbohydrazide, o-toluidine, 3,3'-dimethylbenzidine, benzidine, α,α'-p-diaminodiphenyl, diiodo-p-xylene sulfonic acid, N,N'-ethylene-bis(iodoacetamide), or N,N'-hexamethylene-bis(iodoacetamide).

In some embodiments, the linker comprises a heterobifunctional linker. Exemplary heterobifunctional linker include, but are not limited to, amine-reactive and sulfhydryl cross-linkers such as N-succinimidyl 3-(2-pyridyldithio) propionate (sPDP), long-chain N-succinimidyl 3-(2-pyridyldithio)propionate (LC-sPDP), water-soluble-long-chain N-succinimidyl 3-(2-pyridyldithio) propionate (sulfo-LC-sPDP), succinimidyloxycarbonyl-α-methyl-α-(2-pyridyldithio)toluene (sMPT), sulfosuccinimidyl-6-[α-methyl-α-(2-pyridyldithio)toluamido]hexanoate (sulfo-LC-sMPT), succinimidyl-4-(N-maleimidomethyl)cyclohexane-1-carboxylate (sMCC), sulfosuccinimidyl-4-(N-maleimidomethyl)cyclohexane-1-carboxylate (sulfo-sMCC), m-maleimidobenzoyl-N-hydroxysuccinimide ester (MBs), m-maleimidobenzoyl-N-hydroxysulfosuccinimide ester (sulfo-MBs), N-succinimidyl(4-iodoacteyl)aminobenzoate (sIAB), sulfosuccinimidyl(4-iodoacteyl)aminobenzoate (sulfo-sIAB), succinimidyl-4-(p-maleimidophenyl)butyrate (sMPB), sulfosuccinimidyl-4-(p-maleimidophenyl)butyrate (sulfo-sMPB), N-(γ-maleimidobutyryloxy)succinimide ester (GMBs), N-(γ-maleimidobutyryloxy)sulfosuccinimide ester (sulfo-GMBs), succinimidyl 6-((iodoacetyl)amino)hexanoate (sIAX), succinimidyl 6-[6-(((iodoacetyl)amino) hexanoyl)amino]hexanoate (sIAXX), succinimidyl 4-(((iodoacetyl)amino)methyl)cyclohexane-1-carboxylate (sIAC), succinimidyl 6-((((4-iodoacetyl)amino)methyl)cyclohexane-1-carbonyl)amino) hexanoate (sIACX), p-nitrophenyl iodoacetate (NPIA), carbonyl-reactive and sulfhydryl-reactive cross-linkers such as 4-(4-N-maleimidophenyl) butyric acid hydrazide (MPBH), 4-(N-maleimidomethyl) cyclohexane-1-carboxyl-hydrazide-8 ($M_2C_2H$), 3-(2-pyridyldithio)propionyl hydrazide (PDPH), amine-reactive and photoreactive cross-linkers such as N-hydroxysuccinimidyl-4-azidosalicylic acid (NHs-AsA), N-hydroxysulfosuccinimidyl-4-azidosalicylic acid (sulfo-NHs-AsA), sulfosuccinimidyl-(4-azidosalicylamido)hexanoate (sulfo-NHs-LC-AsA), sulfosuccinimidyl-2-(ρ-azidosalicylamido)ethyl-1,3'-dithiopropionate (sAsD), N-hydroxysuccinimidyl-4-azidobenzoate (HsAB), N-hydroxysulfosuccinimidyl-4-azidobenzoate (sulfo-HsAB), N-succinimidyl-6-(4'-azido-2'-nitrophenylamino)hexanoate (sANPAH), sulfosuccinimidyl-6-(4'-azido-2'-nitrophenylamino)hexanoate (sulfo-sANPAH), N-5-azido-2-nitrobenzoyloxysuccinimide (ANB-NOs), sulfosuccinimidyl-2-(m-azido-o-nitrobenzamido)-ethyl-1,3'-dithiopropionate (sAND), N-succinimidyl-4(4-azidophenyl)1,3'-dithiopropionate (sADP), N-sulfosuccinimidyl(4-azidophenyl)-1,3'-dithiopropionate (sulfo-sADP), sulfosuccinimidyl 4-(ρ-azidophenyl)butyrate (sulfo-sAPB), sulfosuccinimidyl 2-(7-azido-4-methylcoumarin-3-acetamide)ethyl-1,3'-dithiopropionate (sAED), sulfosuccinimidyl 7-azido-4-methylcoumain-3-acetate (sulfo-sAMCA), p-nitrophenyl diazopyruvate (pNPDP), ρ-nitrophenyl-2-diazo-3,3,3-trifluoropropionate (PNP-DTP), sulfhydryl-reactive and photoreactive cross-linkers such as 1-(ρ-Azidosalicylamido)-4-(iodoacetamido) butane (AsIB), N-[4-(ρ-azidosalicylamido)butyl]-3'-(2'-pyridyldithio)propionamide (APDP), benzophenone-4-iodoacetamide, benzophenone-4-maleimide carbonyl-reactive and photoreactive cross-linkers such as ρ-azidobenzoyl hydrazide (ABH), carboxylate-reactive and photoreactive cross-linkers such as 4-(ρ-azidosalicylamido) butylamine (AsBA), and arginine-reactive and photoreactive cross-linkers such as ρ-azidophenyl glyoxal (APG).

In some embodiments, the linker comprises a benzoic acid group, or its derivatives thereof. In some embodiments, the benzoic acid group or its derivatives thereof comprise paraaminobenzoic acid (PABA). In some embodiments, the benzoic acid group or its derivatives thereof comprise gamma-aminobutyric acid (GABA).

In some embodiments, the linker comprises one or more of a maleimide group, a peptide moiety, and/or a benzoic acid group, in any combination. In some embodiments, the linker comprises a combination of a maleimide group, a peptide moiety, and/or a benzoic acid group. In some embodiments, the maleimide group is maleimidocaproyl (mc). In some embodiments, the peptide group is val-cit. In some embodiments, the benzoic acid group is PABA. In some embodiments, the linker comprises a mc-val-cit group. In some embodiments, the linker comprises a val-cit-PABA group. In additional cases, the linker comprises a mc-val-cit-PABA group.

In some embodiments, the linker is a self-immolative linker or a self-elimination linker. In some embodiments, the linker is a self-immolative linker. In other cases, the linker is a self-elimination linker (e.g., a cyclization self-elimination linker). In some embodiments, the linker comprises a linker described in U.S. Pat. No. 9,089,614 or PCT Publication No. WO2015038426.

In some embodiments, the linker is a dendritic type linker. In some embodiments, the dendritic type linker comprises a branching, multifunctional linker moiety. In some embodiments, the dendritic type linker comprises PAMAM dendrimers.

In some embodiments, the linker is a traceless linker or a linker in which after cleavage does not leave behind a linker moiety (e.g., an atom or a linker group) to the antibody or payload. Exemplary traceless linkers include, but are not limited to, germanium linkers, silicium linkers, sulfur linkers, selenium linkers, nitrogen linkers, phosphorus linkers, boron linkers, chromium linkers, or phenylhydrazide linker. In some embodiments, the linker is a traceless aryl-triazene linker as described in Hejesen, et al., "A traceless aryl-triazene linker for DNA-directed chemistry," *Org Biomol Chem* 11(15): 2493-2497 (2013). In some embodiments, the linker is a traceless linker described in Blaney, et al., "Traceless solid-phase organic synthesis," *Chem. Rev.* 102: 2607-2024 (2002). In some embodiments, a linker is a traceless linker as described in U.S. Pat. No. 6,821,783.

Host Cells for Antibody Production

In some embodiments, the present disclosure provides host cells expressing any one of the anti-Gal3 antibodies or binding fragments thereof disclosed herein. A subject host cell typically comprises a nucleic acid encoding any one of the anti-Gal3 antibodies or binding fragments thereof disclosed herein.

The disclosure provides host cells transfected with the polynucleotides, vectors, or a library of the vectors described above. The vectors can be introduced into a suitable prokaryotic or eukaryotic cell by any of a number of appropriate means, including electroporation, microprojectile bombardment; lipofection, infection (where the vector is coupled to an infectious agent), transfection employing calcium chloride, rubidium chloride, calcium phosphate, DEAE-dextran, or other substances. The choice of the means for introducing vectors will often depend on features of the host cell.

For most animal cells, any of the above-mentioned methods is suitable for vector delivery. Preferred animal cells are vertebrate cells, preferably mammalian cells, capable of expressing exogenously introduced gene products in large quantity, e.g. at the milligram level. Non-limiting examples of preferred cells are NIH3T3 cells, COS, HeLa, and CHO cells.

Once introduced into a suitable host cell, expression of the anti-Gal3 antibodies or binding fragments thereof can be determined using any nucleic acid or protein assay known in the art. For example, the presence of transcribed mRNA of light chain CDRs or heavy chain CDRs, or the anti-Gal3 antibody or binding fragment thereof can be detected and/or quantified by conventional hybridization assays (e.g. Northern blot analysis), amplification procedures (e.g. RT-PCR), SAGE (U.S. Pat. No. 5,695,937), and array-based technologies (see e.g. U.S. Pat. Nos. 5,405,783, 5,412,087 and 5,445,934), using probes complementary to any region of a polynucleotide that encodes the anti-Gal3 antibody or binding fragment thereof.

Expression of the vector can also be determined by examining the expressed anti-Gal3 antibody or binding fragment thereof. A variety of techniques are available in the art for protein analysis. They include but are not limited to radioimmunoassays, ELISA (enzyme linked immunoradiometric assays), "sandwich" immunoassays, immunoradiometric assays, in situ immunoassays (using e.g., colloidal gold, enzyme or radioisotope labels), western blot analysis, immunoprecipitation assays, immunofluorescent assays, and SDS-PAGE.

The invention is generally disclosed herein using affirmative language to describe the numerous embodiments. The invention also includes embodiments in which subject matter is excluded, in full or in part, such as substances or materials, method steps and conditions, protocols, or procedures.

Embodiments of the present invention provided herein are described by way of the following numbered arrangements:

1. An anti-Gal3 antibody or binding fragment thereof comprising (1) a light chain variable region comprising a $V_L$-CDR1, a $V_L$-CDR2, and a $V_L$-CDR3; and (2) a heavy chain variable region comprising a $V_H$-CDR1, a $V_H$-CDR2, and a $V_H$-CDR3, wherein the $V_L$-CDR1 comprises an amino acid sequence having at least 60%, at least 70%, at least 80%, at least 90%, or 100% sequence identity to any amino acid sequence according to SEQ ID NOs: 170-220, the $V_L$-CDR2 comprises an amino acid sequence having at least 60%, at least 70%, at least 80%, at least 90%, or 100% sequence identity to any amino acid sequence according to SEQ ID NOs: 221-247, the $V_L$-CDR3 comprises an amino acid sequence having at least 60%, at least 70%, at least 80%, at least 90%, or 100% sequence identity to any amino acid sequence according to SEQ ID NOs: 248-296, the $V_H$-CDR1 comprises an amino acid sequence having at least 60%, at least 70%, at least 80%, at least 90%, or 100% sequence identity to any amino acid sequence according to SEQ ID NOs: 27-70, the $V_H$-CDR2 comprises an amino acid sequence having at least 60%, at least 70%, at least 80%, at least 90%, or 100% sequence identity to any amino acid sequence according to SEQ ID NOs: 71-111, 826, and the $V_H$-CDR3 comprises an amino acid sequence having at least 60%, at least 70%, at least 80%, at least 90%, or 100% sequence identity to any amino acid sequence according to SEQ ID NOs: 112-169, 827.

2. The anti-Gal3 antibody or binding fragment thereof of arrangement 1, wherein the anti-Gal3 antibody or binding fragment comprises a combination of a $V_L$-CDR1, a $V_L$-CDR2, a $V_L$-CDR3, a $V_H$-CDR1, a $V_H$-CDR2, and a $V_H$-CDR3 as illustrated in FIG. 14.

3. The anti-Gal3 antibody or binding fragment thereof of arrangement 1 or 2, wherein the light chain variable region comprises a sequence having at least 80%, 81%, 82%, 83%, 84%, 85%, 86%, 87%, 88%, 89%, 90%, 91%, 92%, 93%, 94%, 95%, 96%, 97%, 98%, or 99% identity to the sequence selected from SEQ ID NOs: 374-447, 823-825.

4. The anti-Gal3 antibody or binding fragment thereof of any one of arrangements 1-3, wherein the light chain variable region comprises the sequence selected from SEQ ID NOs: 374-447, 823-825.

5. The anti-Gal3 antibody or binding fragment thereof of any one of arrangements 1-4, wherein the heavy chain variable region comprises a sequence having at least 80%, 81%, 82%, 83%, 84%, 85%, 86%, 87%, 88%, 89%, 90%, 91%, 92%, 93%, 94%, 95%, 96%, 97%, 98%, or 99% identity to the sequence selected from SEQ ID NOs: 297-373, 822, 828.

6. The anti-Gal3 antibody or binding fragment thereof of any one of arrangements 1-5, wherein the heavy chain variable region comprises the sequence selected from SEQ ID NOs: 297-373, 822, 828.

7. The anti-Gal3 antibody or binding fragment thereof of any one of arrangements 1-6, wherein the anti-Gal3 antibody or binding fragment thereof comprises a light chain, wherein the light chain comprises a sequence having at least 80%, 81%, 82%, 83%, 84%, 85%, 86%, 87%, 88%, 89%, 90%, 91%, 92%, 93%, 94%, 95%, 96%, 97%, 98%, or 99% identity to the sequence selected from SEQ ID NOs: 495-538, 830.

8. The anti-Gal3 antibody or binding fragment thereof of arrangement 7, wherein the light chain comprises the sequence selected from SEQ ID NOs: 495-538, 830.

9. The anti-Gal3 antibody or binding fragment thereof of any one of arrangements 1-8, wherein the anti-Gal3 antibody or binding fragment thereof comprises a heavy chain, wherein the heavy chain comprises a sequence having at least 80%, 81%, 82%, 83%, 84%, 85%, 86%, 87%, 88%, 89%, 90%, 91%, 92%, 93%, 94%, 95%, 96%, 97%, 98%, or 99% identity to the sequence selected from SEQ ID NOs: 448-494, 829.

10. The anti-Gal3 antibody or binding fragment thereof of arrangement 9, wherein the heavy chain comprises the sequence selected from SEQ ID NOs: 448-494, 829.

11. The anti-Gal3 antibody or binding fragment thereof of any one of arrangements 1-10, wherein the anti-Gal3 antibody or binding fragment is selected from the group consisting of: TB001, TB006, 12G5.D7, 13A12.2E5, 14H10.2C9, 15F10.2D6, 19B5.2E6, 20D11.2C6, 20H5.A3, 23H9.2E4, 2D10.2B2, 3B11.2G2, 7D8.2D8, mIMT001, 4A11.2B5, 4A11.H1L1, 4A11.H4L2, 4G2.2G6, 6B3.2D3, 6H6.2D6, 9H2.2H10, 13G4.2F8, 13H12.2F8, 15G7.2A7, 19D9.2E5, 23B10.2B12, 24D12.2H9, F846C.1B2, F846C.1F5, F846C.1H12, F846C.1H5, F846C.2H3, F846TC.14A2, F846TC.14E4, F846TC.16B5, F846TC.7F10, F847C.10B9, F847C.11B1, F847C.12F12, F847C.26F5, F847C.4B10, F849C.8D10, F849C.8H3, 846.2B11, 846.4D5, 846T.1H2, 847.14H4, 846.2D4, 846.2F11, 846T.10B1, 846T.2E3, 846T.4C9, 846T.4E11, 846T.4F5, 846T.8D1, 847.10C9, 847.11D6, 847.15D12, 847.15F9, 847.15H11, 847.20H7, 847.21B11, 847.27B9, 847.28D1, 847.2B8, 847.3B3, 849.1D2, 849.2D7, 849.2F12, 849.4B2, 849.4F12, 849.4F2, 849.5C2, 849.8D12, F847C.21H6, 849.5H1, 847.23F11, 847.16D10, 847.13E2-mH0mL1, 847.13E2-mH0mL2, 847.12C4, 847.4D3, 2D10-VH0-VL0, or binding fragment thereof.

12. A method of treating lung fibrosis in a subject in need thereof, comprising:
administering to the subject an effective amount of an anti-Gal3 antibody or binding fragment thereof;
wherein the anti-Gal3 antibody or binding fragment thereof disrupts an interaction between Gal3 and a TGF-b receptor; and
wherein the lung fibrosis is a sequela of a viral infection.

13. The method of arrangement 12, wherein the viral infection is a coronavirus infection.

14. The method of arrangement 12 or 13, wherein the viral infection is a SARS-related coronavirus infection.

15. The method of any one of arrangements 12-14, wherein the viral infection is a SARS-CoV-2 coronavirus infection.

16. A method of disrupting an interaction between Gal3 and a SARS-CoV-2-associated host cell receptor comprising:
contacting the SARS-CoV-2-associated host cell receptor with an anti-Gal3 antibody or binding fragment thereof;
wherein the SARS-CoV-2-associated host cell receptor is ACE2 or CD147.

17. A method of disrupting an interaction between Gal3 and a SARS-CoV-2 S protein comprising:
contacting the SARS-CoV-2 S protein with an anti-Gal3 antibody or binding fragment thereof.

18. A method of treating a SARS-CoV-2 infection in a subject in need thereof, comprising:
administering to the subject an effective amount of an anti-Gal3 antibody or binding fragment thereof;
wherein the anti-Gal3 antibody or binding fragment thereof disrupts an interaction between Gal3 and a SARS-CoV-2-associated host cell receptor or a SAR-CoV-2 protein; and
wherein the SARS-CoV-2 associated host cell receptor is ACE2 or CD147 or the SARS-CoV-2 protein is the SARS-CoV-2 S protein.

19. A method of treating a viral infection in a subject in need thereof, comprising:
administering to the subject an effective amount of an anti-Gal3 antibody or binding fragment thereof;
wherein the anti-Gal3 antibody or binding fragment thereof disrupts an interaction between Gal3 and a viral protein.

20. The method of arrangement 19, wherein the viral infection is a coronavirus infection and the viral protein is a coronavirus protein.

21. The method of arrangement 19 or 20, wherein the viral infection is a SARS-related coronavirus infection and the viral protein is a SARS-related coronavirus protein.

22. The method of any one of arrangements 19-21, wherein the viral infection is a SARS-CoV-2 viral infection and the viral protein is a SARS-CoV-2 S protein.

23. A method of treating SARS-CoV-2 infection, comprising:
administering to a subject an effective amount of an anti-Gal3 antibody or binding fragment thereof, wherein the anti-Gal3 antibody or binding fragment thereof disrupts an interaction between Gal3 and a SARS-CoV-2 S protein, and wherein the anti-Gal3 antibody is capable of binding to:
(a) Gal3 on a SARS-CoV-2 virus, or
(b) Gal3 associated with a cell.

24. The method of arrangement 23, wherein the Gal3 associated with a cell is a Gal3 expressed by the cell.

25. The method of arrangement 24, wherein the Gal3 associated with a cell is a Gal3 bound to the cell surface.

26. A method of preventing and/or reducing a viral spread, the method comprising:
administering to a subject an effective amount of an anti-Gal3 antibody or binding fragment thereof, wherein the anti-Gal3 antibody or binding fragment thereof disrupts an interaction between Gal3 and ACE2 and/or Gal3 and CD147.

27. A method of reducing a risk that a virus can invade a cell, the method comprising:
administering to a cell an anti-Gal3 antibody or binding fragment thereof, wherein the anti-Gal3 antibody or binding fragment thereof disrupts an interaction between Gal3 and ACE2 and/or Gal3 and CD147.

28. A method of decreasing or inhibiting toxicity in a subject experiencing cytokine release syndrome (CRS) or vulnerable to CRS, the method comprising:
administering to the subject an effective amount of an anti-Gal3 antibody or binding fragment thereof.

29. The method of arrangement 28, wherein the CRS is a result of a bacterial infection, viral infection, fungal infection, protozoan infection, graft-versus-host disease, cytomegalovirus, Epstein-Barr virus, hemophagocytic lymphohistiocystosis (HLH), Epstein-Barr virus-associated HLH, sporadic HLH, macrophage activation syndrome (MAS), chronic arthritis, systemic Juvenile idiopathic Arthritis (sJIA), Still's Disease, Cryopyrin-associated Periodic Syndrome (CAPS), Familial Cold Auto-inflammatory Syndrome (FCAS), Familial Cold Urticaria (FCU), Muckle-Well Syndrome (MWS), Chronic Infantile Neurological Cutaneous and Articular (CINCA) Syndrome, cryopyrinopathy comprising inherited or de novo gain of function mutations in the NLRP3 gene, a hereditary auto-inflammatory disorder, acute pancreatitis, severe burns, trauma, acute respiratory distress syndrome (ARDS), *Streptococcus*, *Pseudomonas*, influenza, bird flu, H5N1, H1N1, variola virus, coronavirus, severe acute respiratory syndrome (SARS), SARS-CoV-1, SARS-CoV-2, sepsis, gram-negative sepsis, Gram-positive toxins, malaria, Ebola virus, variola virus, systemic Gram-negative bacterial infection, bacteremia, Jarisch-Herxheimer syndrome, glycosylphosphatidylinositol (GPI), or lipopolysaccharide, or treatment with an immunotherapy comprising rituximab, obinutuzumab, alemtuzumab, brentuximab, dacetuzumab, nivolumab, theralizumab, oxaliplatin, lenalidomide, T-cell engager molecules, bi-specific T-cell engager (BiTE) molecules, or CAR T therapy.

30. The method of arrangement 29, wherein the CRS is a result of sepsis.

31. The method of arrangement 29 or 30, wherein the sepsis is bacterial sepsis, viral sepsis, fungal sepsis, or protozoan sepsis.

32. The method of any one of arrangements 28-31, wherein the CRS is a result of a viral infection.

33. The method of any one of arrangements 28-32, wherein the CRS is a result of a coronavirus infection.

34. The method of any one of arrangements 28-33, wherein the CRS is a result of a SARS-related coronavirus infection.

35. The method of any one of arrangements 28-34, wherein the CRS is a result of a SARS-CoV-2 coronavirus infection.

36. A method of decreasing or inhibiting inflammation in a subject in need thereof, the method comprising:
administering to the subject an effective amount of an anti-Gal3 antibody or binding fragment thereof.

37. The method of arrangement 36, wherein the inflammation in the subject is associated with neutrophil activation and/or migration.

38. The method of arrangement 36 or 37, wherein administration of the effective amount of the anti-Gal3 antibody or binding fragment thereof decreases or inhibits neutrophil activation and/or migration in the subject.

39. The method of any one of arrangements 36-38, wherein administration of the effective amount of the anti-Gal3 antibody or binding fragment thereof decreases or inhibits cleavage of CD62L expressed by neutrophils and/or decreases or inhibits IL-8 production in the subject.

40. The method of any one of arrangements 36-39, further comprising detecting a decrease in neutrophil CD62L cleavage and/or a decrease in IL-8 production in the subject after the administering step.

41. The method of any one of arrangements 36-40, wherein administration of the effective amount of the anti-Gal3 antibody or binding fragment thereof decreases the number of neutrophils in the subject.

42. The method of any one of arrangements 36-41, further comprising detecting a decrease in the number of neutrophils in the subject after the administering step.

43. The method of any one of arrangements 36-42, wherein administration of the effective amount of the anti-Gal3 antibody or binding fragment thereof modulates expression of Gal3, myeloperoxidase (MPO), growth-related oncogene α (GROα)/keratinocytes-derived chemokine (KC), Ly6c1, INOS, IL-6, TNFα, IL-1B, Col1A1, aSMA, TGFβ, VEGFA, VEGFB, or any combination thereof, in the subject.

44. The method of any one of arrangements 36-43, further comprising detecting a change in expression of Gal3, MPO, GROα/KC, Ly6c1, INOS, IL-6, TNFα, IL-1B, Col1A1, aSMA, TGFβ, VEGFA, VEGFB, or any combination thereof, in the subject after the administrating step.

45. The method of any one of arrangements 36-44, wherein administration of the effective amount of the anti-Gal3 antibody or binding fragment thereof decreases production of autoantibodies in the subject.

46. The method of arrangement 45, wherein the autoantibodies are anti-nucleic acid autoantibodies.

47. The method of any one of arrangements 36-46, wherein the inflammation comprises lung inflammation.

48. The method of any one of arrangements 36-47, wherein the inflammation comprises COPD, pneumonitis, asthma, sarcoidosis, pulmonary fibrosis, histiocytosis, bronchiolitis obliterans, or any combination thereof.

49. The method of any one of arrangements 36-48, wherein the inflammation comprises an autoimmune disease.

50. The method of arrangement 49, wherein the autoimmune disease comprises systemic lupus erythematosus (SLE), Graves' disease, rheumatoid arthritis, multiple sclerosis, Sjogren's syndrome, celiac disease, or any combination thereof.

51. The method of any one of arrangements 36-50, further comprising detecting an improvement in the inflammation in the subject after the administrating step.

52. A method of decreasing or inhibiting cleavage of CD62L, decreasing IL-8 production, and/or modulating expression of Gal3, MPO, GROα/KC, Ly6c1, INOS, IL-6, TNFα, IL-1B, Col1A1, aSMA, TGFβ, VEGFA, VEGFB, or any combination thereof, by a cell, comprising contacting the cell with an anti-Gal3 antibody or binding fragment thereof, thereby decreasing or inhibiting cleavage of CD62L, decreasing IL-8 production, and/or modulating expression of Gal3, MPO, GROα/KC, Ly6c1, INOS, IL-6, TNFα, IL-1B, Col1A1, aSMA, TGFβ, VEGFA, VEGFB, or any combination thereof, by the cell.

53. The method of arrangement 52, wherein the cell is an immune cell.

54. The method of arrangement 53, wherein the immune cell is a neutrophil.

55. The method of any one of arrangements 52-54, wherein cleavage of CD62L is decreased by at least 60%, 65%, 70%, 75%, 80%, 85%, 90%, 95%, 96%, 97%, 98%, 99%, or 100%, IL-8 production is decreased by at least 1%, 2%, 3%, 4%, 5%, 10%, 15%, 20%, 25%, 30%, 35%, 40%, 45%, 50%, 55%, 60%, 65%, 70%, 75%, 80%, 85%, 90%, 95%, or 100%, TNFα expression is decreased by at least 10%, 15%, 20%, 25%, 30%, 35%, 40%, 45%, 50%, 55%, 60%, 65%, 70%, 75%, 80%, 85%, 90%, 95%, or 100%, and/or IL-6 expression is decreased by at least 10%, 15%, 20%, 25%, 30%, 35%, 40%, 45%, 50%, 55%, 60%, 65%, 70%, 75%, 80%, 85%, 90%, 95%, or 100%.

56. The method of any one of arrangements 52-55, wherein the decrease or inhibition of cleavage of CD62L, decrease in IL-8 production, and/or change in expression of Gal3, MPO, GROα/KC, Ly6c1, INOS, IL-6, TNFα, IL-1B, Col1A1, aSMA, TGFβ, VEGFA, VEGFB, or any combination thereof is determined by ELISA.

57. The method of any one of arrangements 12-35, wherein the anti-Gal3 antibody or binding fragment thereof is specific for the N-terminus of Gal3, the N-terminal domain of Gal3, or the tandem repeat domain (TRD) of Gal3.

58. The method of any one of arrangements 12-57, wherein the anti-Gal3 antibody or binding fragment thereof binds to the N-terminus of Gal3.

59. The method of any one of arrangements 12-58, wherein the anti-Gal3 antibody or binding fragment thereof binds to the N-terminal domain of Gal3.

60. The method of any one of arrangements 12-59, wherein the anti-Gal3 antibody or binding fragment thereof binds to the tandem repeat domain of Gal3.

61. The method of any one of arrangements 12-60, wherein the anti-Gal3 antibody or binding fragment thereof binds to Peptide 1 (ADNFSLHDALSGSGNPNPQG; SEQ ID NO: 3).

62. The method of any one of arrangements 12-61, wherein the anti-Gal3 antibody or binding fragment thereof binds to Peptide 6 (GAYPGQAPPGAYPGAPGAYP; SEQ ID NO: 8).

63. The method of any one of arrangements 12-62, wherein the anti-Gal3 antibody or binding fragment thereof binds to Peptide 7 (AYPGAPGAYPGAPAPGVYPG; SEQ ID NO: 9).

64. The method of any one of arrangements 12-63, wherein the anti-Gal3 antibody or binding fragment thereof comprises (1) a light chain variable region comprising a $V_L$-CDR1, a $V_L$-CDR2, and a $V_L$-CDR3; and (2) a heavy chain variable region comprising a $V_H$-CDR1, a $V_H$-CDR2, and a $V_H$-CDR3, wherein
the $V_L$-CDR1 comprises an amino acid sequence having at least 60%, at least 70%, at least 80%, at least 90%, or 100% sequence identity to any amino acid sequence according to SEQ ID NOs: 170-220,
the $V_L$-CDR2 comprises an amino acid sequence having at least 60%, at least 70%, at least 80%, at least 90%, or 100% sequence identity to any amino acid sequence according to SEQ ID NOs: 221-247,
the $V_L$-CDR3 comprises an amino acid sequence having at least 60%, at least 70%, at least 80%, at least 90%, or 100% sequence identity to any amino acid sequence according to SEQ ID NOs: 248-296,
the $V_H$-CDR1 comprises an amino acid sequence having at least 60%, at least 70%, at least 80%, at least 90%, or 100% sequence identity to any amino acid sequence according to SEQ ID NOs: 27-70,
the $V_H$-CDR2 comprises an amino acid sequence having at least 60%, at least 70%, at least 80%, at least 90%, or 100% sequence identity to any amino acid sequence according to SEQ ID NOs: 71-111, 826, and
the $V_H$-CDR3 comprises an amino acid sequence having at least 60%, at least 70%, at least 80%, at least 90%, or 100% sequence identity to any amino acid sequence according to SEQ ID NOs: 112-169, 827.

65. The method of any one of arrangements 12-64, wherein the anti-Gal3 antibody or binding fragment comprises a combination of a $V_L$-CDR1, a $V_L$-CDR2, a $V_L$-CDR3, a $V_H$-CDR1, a $V_H$-CDR2, and a $V_H$-CDR3 as illustrated in FIG. 14.

66. The method of arrangement 64 or 65, wherein the light chain variable region comprises a sequence having at least 80%, 81%, 82%, 83%, 84%, 85%, 86%, 87%, 88%, 89%, 90%, 91%, 92%, 93%, 94%, 95%, 96%, 97%, 98%, or 99% identity to the sequence selected from SEQ ID NOs: 374-449.

67. The method of any one of arrangements 64-66, wherein the light chain variable region comprises the sequence selected from SEQ ID NOs: 374-449.

68. The method of any one of arrangements 64-67, wherein the heavy chain variable region comprises a sequence having at least 80%, 81%, 82%, 83%, 84%, 85%, 86%, 87%, 88%, 89%, 90%, 91%, 92%, 93%, 94%, 95%, 96%, 97%, 98%, or 99% identity to the sequence selected from SEQ ID NOs: 297-373, 822, 828.

69. The method of any one of arrangements 64-68, wherein the heavy chain variable region comprises the sequence selected from SEQ ID NOs: 297-373, 822, 828.

70. The method of any one of arrangements 64-69, wherein the anti-Gal3 antibody or binding fragment thereof comprises a light chain, wherein the light chain comprises a sequence having at least 80%, 81%, 82%, 83%, 84%, 85%, 86%, 87%, 88%, 89%, 90%, 91%, 92%, 93%, 94%, 95%, 96%, 97%, 98%, or 99% identity to the sequence selected from SEQ ID NOs: 495-538, 830.

71. The method of arrangement 70, wherein the light chain comprises the sequence selected from SEQ ID NOs: 495-538, 830.

72. The method of any one of arrangements 64-71, wherein the anti-Gal3 antibody or binding fragment thereof comprises a heavy chain, wherein the heavy chain comprises a sequence having at least 80%, 81%, 82%, 83%, 84%, 85%, 86%, 87%, 88%, 89%, 90%, 91%, 92%, 93%, 94%, 95%, 96%, 97%, 98%, or 99% identity to the sequence selected from SEQ ID NOs: 448-494, 829.

73. The method of arrangement 72, wherein the heavy chain comprises the sequence selected from SEQ ID NOs: 448-494, 829.

74. The method of any one of arrangements 12-73, wherein the anti-Gal3 antibody or binding fragment thereof is selected from the group consisting of: TB001, TB006, 12G5.D7, 13A12.2E5, 14H10.2C9, 15F10.2D6, 19B5.2E6, 20D11.2C6, 20H5.A3, 23H9.2E4, 2D10.2B2, 3B11.2G2, 7D8.2D8, mIMT001, 4A11.2B5, 4A11.H1L1, 4A11.H4L2, 4G2.2G6, 6B3.2D3, 6H6.2D6, 9H2.2H10, 13G4.2F8, 13H12.2F8, 15G7.2A7, 19D9.2E5, 23B10.2B12, 24D12.2H9, F846C.1B2, F846C.1F5, F846C.1H12, F846C.1H5, F846C.2H3, F846TC.14A2, F846TC.14E4, F846TC.16B5, F846TC.7F10, F847C.10B9, F847C.11B1, F847C.12F12, F847C.26F5, F847C.4B10, F849C.8D10, F849C.8H3, 846.2B11, 846.4D5, 846T.1H2, 847.14H4, 846.2D4, 846.2F11, 846T.10B1, 846T.2E3, 846T.4C9, 846T.4E11, 846T.4F5, 846T.8D1, 847.10C9, 847.11D6, 847.15D12, 847.15F9, 847.15H11, 847.20H7, 847.21B11, 847.27B9, 847.28D1, 847.2B8, 847.3B3, 849.1D2, 849.2D7, 849.2F12, 849.4B2, 849.4F12, 849.4F2, 849.5C2, 849.8D12, F847C.21H6, 849.5H1, 847.23F11, 847.16D10, 847.13E2-mH0mL1, 847.13E2-mH0mL2, 847.12C4, 847.4D3, 2D10-VH0-VL0, or binding fragment thereof.

75. The method of any one of arrangements 12-74, further comprising administering one or more antiviral or anti-inflammatory therapeutics selected from the group consisting of chloroquine, hydroxychloroquine, favipiravir, favilavir, remdesivir, tocilizumab, baricitinib, acalabrutinib, galidesivir, sarilumab, lopinavir, ritonavir, darunavir, ribavirin, dexamethasone, ciclesonide, convalescent plasma, interferon-α, pegylated interferon-α, and interferon alfa-2b, or any combination thereof.

76. The use of an anti-Gal3 antibody or binding fragment thereof for the treatment of CRS.

77. The use of arrangement 76, wherein the CRS is a result of a bacterial infection, viral infection, fungal infection, protozoan infection, graft-versus-host disease, cytomegalovirus, Epstein-Barr virus, hemophagocytic lymphohistiocystosis (HLH), Epstein-Barr virus-associated HLH, sporadic HLH, macrophage activation syndrome (MAS), chronic arthritis, systemic Juvenile idiopathic Arthritis (sJIA), Still's Disease, Cryopyrin-associated Periodic Syndrome (CAPS), Familial Cold Auto-inflammatory Syndrome (FCAS), Familial Cold Urticaria (FCU), Muckle-Well Syndrome (MWS), Chronic Infantile Neurological Cutaneous and Articular (CINCA) Syndrome, cryopyrinopathy comprising inherited or de novo gain of function mutations in the NLRP3 gene, a hereditary auto-inflammatory disorder, acute pancreatitis, severe burns, trauma, acute respiratory distress syndrome (ARDS), *Streptococcus, Pseudomonas*, influenza, bird flu, H5N1, H1N1, variola virus, coronavirus, severe acute respiratory syndrome (SARS), SARS-CoV-1, SARS-CoV-2, sepsis, gram-negative sepsis, Gram-positive toxins, malaria, Ebola virus, variola virus, systemic Gram-negative bacterial infection, bacteremia, Jarisch-Herxheimer syndrome, glycosylphosphatidylinositol (GPI), or lipopolysaccharide, or treatment with an immunotherapy comprising rituximab, obinutuzumab, alemtuzumab, brentuximab, dacetuzumab, nivolumab, theralizumab, oxaliplatin, lenalidomide, T-cell engager molecules, bi-specific T-cell engager (BiTE) molecules, or CAR T therapy.

78. The use of arrangement 76 or 77, wherein the CRS is a result of sepsis.

79. The use of any one of arrangements 76-78, wherein the sepsis is bacterial sepsis, viral sepsis, fungal sepsis, or protozoan sepsis.

80. The use of an anti-Gal3 antibody or binding fragment thereof for the treatment of lung fibrosis, wherein the lung fibrosis is a sequela of a viral infection.

81. The use of an anti-Gal3 antibody or binding fragment thereof for the treatment of a viral infection.

82. The use of any one of arrangements 76-81, wherein the viral infection is a coronavirus infection.

83. The use of any one of arrangements 76-82, wherein the viral infection is a SARS-related coronavirus infection.

84. The use of any one of arrangements 76-83, wherein the viral infection is a SARS-CoV-2 coronavirus infection.

85. The use of any one of arrangements 76-84, wherein the anti-Gal3 antibody or binding fragment thereof binds to the N-terminus of Gal3.

86. The use of any one of arrangements 76-85, wherein the anti-Gal3 antibody or binding fragment thereof binds to the N-terminal domain of Gal3.

87. The use of any one of arrangements 76-86, wherein the anti-Gal3 antibody or binding fragment thereof binds to the tandem repeat domain of Gal3.

88. The use of any one of arrangements 76-87, wherein the anti-Gal3 antibody or binding fragment thereof binds to Peptide 1 (ADNFSLHDALSGSGNPNPQG; SEQ ID NO: 3).

89. The use of any one of arrangements 76-87, wherein the anti-Gal3 antibody or binding fragment thereof binds to Peptide 6 (GAYPGQAPPGAYPGAPGAYP; SEQ ID NO: 8).

90. The use of any one of arrangements 76-87, wherein the anti-Gal3 antibody or binding fragment thereof binds to Peptide 7 (AYPGAPGAYPGAPAPGVYPG; SEQ ID NO: 9).

91. The use of any one of arrangements 76-90, wherein the anti-Gal3 antibody or binding fragment thereof comprises (1) a light chain variable region comprising a $V_L$-CDR1, a $V_L$-CDR2, and a $V_L$-CDR3; and (2) a heavy chain variable region comprising a $V_H$-CDR1, a $V_H$-CDR2, and a $V_H$-CDR3, wherein the $V_L$-CDR1 comprises an amino acid sequence having at least 60%, at least 70%, at least 80%, at least 90%, or 100% sequence identity to any amino acid sequence according to SEQ ID NOs: 170-220, the $V_L$-CDR2 comprises an amino acid sequence having at least 60%, at least 70%, at least 80%, at least 90%, or 100% sequence identity to any amino acid sequence according to SEQ ID NOs: 221-247, the $V_L$-CDR3 comprises an amino acid sequence having at least 60%, at least 70%, at least 80%, at least 90%, or 100% sequence identity to any amino acid sequence according to SEQ ID NOs: 248-296, the $V_H$-CDR1 comprises an amino acid sequence having at least 60%, at least 70%, at least 80%, at least 90%, or 100% sequence identity to any amino acid sequence according to SEQ ID NOs: 27-70, the $V_H$-CDR2 comprises an amino acid sequence having at least 60%, at least 70%, at least 80%, at least 90%, or 100% sequence identity to any amino acid sequence according to SEQ ID NOs: 71-111, 826, and the $V_H$-CDR3 comprises an amino acid sequence having at least 60%, at least 70%, at least 80%, at least 90%, or 100% sequence identity to any amino acid sequence according to SEQ ID NOs: 112-169, 827.

92. The use of any one of arrangements 76-91, wherein the anti-Gal3 antibody or binding fragment comprises a combination of a $V_L$-CDR1, a $V_L$-CDR2, a $V_L$-CDR3, a $V_H$-CDR1, a $V_H$-CDR2, and a $V_H$-CDR3 as illustrated in FIG. 14.

93. The use of arrangement 91 or 92, wherein the light chain variable region comprises a sequence having at least 80%, 81%, 82%, 83%, 84%, 85%, 86%, 87%, 88%, 89%, 90%, 91%, 92%, 93%, 94%, 95%, 96%, 97%, 98%, or 99% identity to the sequence selected from SEQ ID NOs: 374-447, 823-825.

94. The use of any one of arrangements 91-93, wherein the light chain variable region comprises the sequence selected from SEQ ID NOs: 374-447, 823-825.

95. The use of any one of arrangements 91-94, wherein the heavy chain variable region comprises a sequence having at least 80%, 81%, 82%, 83%, 84%, 85%, 86%, 87%, 88%, 89%, 90%, 91%, 92%, 93%, 94%, 95%, 96%, 97%, 98%, or 99% identity to the sequence selected from SEQ ID NOs: 297-373, 822, 828.

96. The use of any one of arrangements 91-95, wherein the heavy chain variable region comprises the sequence selected from SEQ ID NOs: 297-373, 822, 828.

97. The use of any one of arrangements 91-96, wherein the anti-Gal3 antibody or binding fragment thereof comprises a light chain, wherein the light chain comprises a sequence having at least 80%, 81%, 82%, 83%, 84%, 85%, 86%, 87%, 88%, 89%, 90%, 91%, 92%, 93%, 94%, 95%, 96%, 97%, 98%, or 99% identity to the sequence selected from SEQ ID NOs: 495-538, 830.

98. The use of arrangement 97, wherein the light chain comprises the sequence selected from SEQ ID NOs: 495-538, 830.

99. The use of any one of arrangements 91-98, wherein the anti-Gal3 antibody or binding fragment thereof comprises a heavy chain, wherein the heavy chain comprises a sequence having at least 80%, 81%, 82%, 83%, 84%, 85%, 86%, 87%, 88%, 89%, 90%, 91%, 92%, 93%, 94%, 95%, 96%, 97%, 98%, or 99% identity to the sequence selected from SEQ ID NOs: 448-494, 829.

100. The use of arrangement 99, wherein the heavy chain comprises the sequence selected from SEQ ID NOs: 448-494, 829.

101. The use of any one of arrangements 76-100, wherein the anti-Gal3 antibody or binding fragment thereof is selected from the group consisting of: TB001, TB006, 12G5.D7, 13A12.2E5, 14H10.2C9, 15F10.2D6, 19B5.2E6, 20D11.2C6, 20H5.A3, 23H9.2E4, 2D10.2B2, 3B11.2G2, 7D8.2D8, mIMT001, 4A11.2B5, 4A11.H1L1, 4A11.H4L2, 4G2.2G6, 6B3.2D3, 6H6.2D6, 9H2.2H10, 13G4.2F8, 13H12.2F8, 15G7.2A7, 19D9.2E5, 23B10.2B12, 24D12.2H9, F846C.1B2, F846C.1F5, F846C.1H12, F846C.1H5, F846C.2H3, F846TC.14A2, F846TC.14E4, F846TC.16B5, F846TC.7F10, F847C.10B9, F847C.11B1, F847C.12F12, F847C.26F5, F847C.4B10, F849C.8D10, F849C.8H3, 846.2B11, 846.4D5, 846T.1H2, 847.14H4, 846.2D4, 846.2F11, 846T.10B1, 846T.2E3, 846T.4C9, 846T.4E11, 846T.4F5, 846T.8D1, 847.10C9, 847.11D6, 847.15D12, 847.15F9, 847.15H11, 847.20H7, 847.21B11, 847.27B9, 847.28D1, 847.2B8, 847.3B3, 849.1D2, 849.2D7, 849.2F12, 849.4B2, 849.4F12, 849.4F2, 849.5C2, 849.8D12, F847C.21H6, 849.5H1, 847.23F11, 847.16D10, 847.13E2-mH0mL1, 847.13E2-mH0mL2, 847.12C4, 847.4D3, 2D10-VH0-VL0, or binding fragment thereof.

102. A method of treating a disorder, the method comprising:
administering to a subject an effective amount of an anti-Gal3 antibody or binding fragment thereof, wherein the disorder is selected from at least one of: bacterial infection, viral infection, fungal infection, protozoan infection, graft-versus-host disease, cytomegalovirus, Epstein-Barr virus, hemophagocytic lymphohistiocystosis (HLH), Epstein-Barr virus-associated HLH, sporadic HLH, macrophage activation syndrome (MAS), chronic arthritis, systemic Juvenile idiopathic Arthritis (sJIA), Still's Disease, Cryopyrin-associated Periodic Syndrome (CAPS), Familial Cold Auto-inflammatory Syndrome (FCAS), Familial Cold Urticaria (FCU), Muckle-Well Syndrome (MWS), Chronic Infantile Neurological Cutaneous and Articular (CINCA) Syndrome, cryopyrinopathy comprising inherited or de novo gain of function mutations in the NLRP3 gene, a hereditary auto-inflammatory disorder, acute pancreatitis, severe burns, trauma, acute respiratory distress syndrome (ARDS), *Streptococcus, Pseudomonas*, influenza, bird flu, H5N1, H1N1, variola virus, coronavirus, severe acute respiratory syndrome (SARS), SARS-CoV-1, SARS-CoV-2, sepsis, gram-negative sepsis, Gram-positive toxins, malaria, Ebola virus, variola virus, systemic Gram-negative bacterial infection, bacteremia, Jarisch-Herxheimer syndrome, glycosylphosphatidylinositol (GPI), or lipopolysaccharide, or treatment with an immunotherapy comprising rituximab, obinutuzumab, alemtuzumab, brentuximab, dacetuzumab, nivolumab, theralizumab, oxaliplatin, lenalidomide, T-cell engager molecules, bi-specific T-cell engager (BiTE) molecules, or CAR T therapy.

103. A pharmaceutical antibody formulation comprising:
a therapeutically effective amount of the antibody of any one of arrangements 1-11;
histidine;
methionine;
NaCl; and
polysorbate, wherein the formulation is at a pH between 5.3 and 6.3.

104. The pharmaceutical antibody formulation of arrangement 103, wherein the antibody comprises a $V_H$-CDR1 having the sequence of SEQ ID NO: 31, a $V_H$-CDR2 having the sequence of SEQ ID NO: 72, a $V_H$-CDR3 having the sequence of SEQ ID NO: 113, a $V_L$-CDR1 having the sequence of SEQ ID NO: 171, a $V_L$-CDR2 having the sequence of SEQ ID NO: 222; and a $V_L$-CDR3 having the sequence of SEQ ID NO: 249.

105. The pharmaceutical antibody formulation of arrangement 103 or 104, wherein the histidine is L-histidine.

106. The pharmaceutical antibody formulation of arrangement 105, wherein the L-histidine is present at 10 to 50 mM.

107. The pharmaceutical antibody formulation of arrangement 105 or 106, wherein the L-histidine is present at about 20 mM.

108. The pharmaceutical antibody formulation of any one of arrangements 103-107, wherein the methionine is present at 2 to 10 mM.

109. The pharmaceutical antibody formulation of any one of arrangements 103-108, wherein the methionine is present at 5 mM.

110. The pharmaceutical antibody formulation of any one of arrangements 103-109, wherein the NaCl is present at 50 to 150 mM.

111. The pharmaceutical antibody formulation of any one of arrangements 103-110, wherein the NaCl is present at 100 mM.

112. The pharmaceutical antibody formulation of any one of arrangements 103-111, wherein the polysorbate comprises polysorbate-20, polysorbate-40, polysorbate-60, polysorbate-80, or any combination thereof.

113. The pharmaceutical antibody formulation of any one of arrangements 103-112, wherein the polysorbate comprises polysorbate-80.

114. The pharmaceutical antibody formulation of arrangement 113, wherein the polysorbate 80 is present at 0.01 to 0.04% or about 0.01% to about 0.04%.

115. The pharmaceutical antibody formulation of arrangement 114, wherein the polysorbate 80 is present at 0.02% or about 0.02%.

116. The pharmaceutical antibody formulation of any one of arrangements 103-115, wherein the pH is about 5.8.

117. The pharmaceutical antibody formulation of any one of arrangements 103-116, wherein the pH is 5.8.

118. The pharmaceutical antibody formulation of any one of arrangements 103-117, further comprising sucrose, mannitol, or both.

119. The pharmaceutical antibody formulation of arrangement 118, wherein the sucrose is present at 2% to 5% or about 2% to about 5%.

120. The pharmaceutical antibody formulation of arrangement 118 or 119, wherein mannitol is present at 2% to 5% or about 2% to about 5%.

121. The pharmaceutical antibody formulation of any one of arrangements 103-120, wherein the antibody is present at an amount of 1 to 50 mg as a unit dose.

122. The pharmaceutical antibody formulation of any one of arrangements 103-121, wherein the antibody is present at an amount of one of: 1 mg, 5 mg, 10 mg, 20 mg, 40 mg, or 50 mg as a unit dose, or any amount within a range defined by any two of the aforementioned amounts.

123. The pharmaceutical antibody formulation of any one of arrangements 103-122, wherein the antibody is present at a concentration of one of: 1 mg/mL, 5 mg/mL, 10 mg/mL, 20 mg/mL, 40 mg/mL, or 50 mg/mL, or any concentration within a range defined by any two of the aforementioned concentrations.

124. The pharmaceutical antibody formulation of any one of arrangements 103-123, wherein L-histidine is present at about 20 mM, methionine is present at about 5 mM, NaCl is present at about 100 mM, polysorbate 80 is present at about 0.02%, sucrose is present at 2-5%, mannitol is present at 2-5%, the pH is about 5.8, and wherein the therapeutically effective amount of the antibody is one of: 1 mg, 5 mg, 10 mg, 20 mg, 40 mg, or 50 mg as a unit dose, or any amount within a range defined by any two of the aforementioned amounts.

125. A pharmaceutical antibody formulation comprising:
a therapeutically effective amount of an antibody,
wherein the antibody comprises a $V_H$-CDR1 having the sequence of SEQ ID NO: 31, a $V_H$-CDR2 having the sequence of SEQ ID NO: 72, a $V_H$-CDR3 having the sequence of SEQ ID NO: 113, a $V_L$-CDR1 having the sequence of SEQ ID NO: 171, a $V_L$-CDR2 having the sequence of SEQ ID NO: 222; and a $V_L$-CDR3 having the sequence of SEQ ID NO: 249, and wherein the antibody is present at an amount as a unit dose of: 1 mg, 5 mg, 10 mg, 20 mg, 40 mg, or 50 mg;
L-histidine is present at 20 mM;
methionine is present at 5 mM;
NaCl is present at 100 mM;
polysorbate 80 is present at 0.02%; and
the pH is about 5.8.

126. The pharmaceutical antibody formulation of any one of arrangements 103-125, wherein sucrose is present at 2-5% and mannitol is present at 2-5%.

127. The pharmaceutical antibody formulation of any one of arrangements 103-126, wherein the formulation is configured for parenteral administration.

128. The pharmaceutical antibody formulation of any one of arrangements 103-127, wherein the formulation is configured for subcutaneous administration.

129. The pharmaceutical antibody formulation of arrangement 128, wherein the formulation configured for subcutaneous administration comprises sucrose or mannitol, or both.

130. The pharmaceutical antibody formulation of any one of arrangements 103-127, wherein the formulation is configured for intravenous administration.

131. The pharmaceutical antibody formulation of arrangement 130, wherein the formulation configured for intravenous administration does not comprise sucrose or mannitol, or both.

132. The pharmaceutical antibody formulation of any one of arrangements 103-131, wherein the pharmaceutical antibody formulation is prepared at a concentration of antibody of 20 mg/mL or 50 mg/mL.

133. The pharmaceutical antibody formulation of any one of arrangements 103-132, wherein the pharmaceutical antibody formulation remains 60% stable over 3 months at either 5° C. or 25° C./60% relative humidity (RH).

134. A sterile vial comprising a pharmaceutical antibody formulation, wherein the pharmaceutical antibody formulation comprises a therapeutically effective amount of an antibody, wherein the antibody comprises a $V_H$-CDR1 having the sequence of SEQ ID NO: 31, a $V_H$-CDR2 having the sequence of SEQ ID NO: 72, a $V_H$-CDR3 having the sequence of SEQ ID NO: 113, a $V_L$-CDR1 having the sequence of SEQ ID NO: 171, a $V_L$-CDR2 having the sequence of SEQ ID NO: 222; and a $V_L$-CDR3 having the sequence of SEQ ID NO: 249.

135. The sterile vial of arrangement 134, wherein the pharmaceutical antibody formation further comprises histidine, methionine, NaCl, and polysorbate, and wherein the formulation is at a pH between 5.3 and 6.3.

136. The sterile vial of arrangement 134 or 135, wherein the sterile vial is a 5 mL or 10 mL sterile vial.

137. The sterile vial of any one of arrangements 134-136, wherein the sterile vial contains 2, 3, 4, 5, 6, 7, 8, 9, or 10 mL of the pharmaceutical antibody formulation.

138. The sterile vial of any one of arrangements 134-137, wherein the sterile vial contains 2 mL or at least 2 mL of the pharmaceutical antibody formulation.

139. The sterile vial of any one of arrangements 134-137, wherein the sterile vial contains 8 mL or at least 8 mL of the pharmaceutical antibody formulation.

140. The sterile vial of any one of arrangements 134-139, wherein the pharmaceutical antibody formulation is a concentrated form of the pharmaceutical antibody formulation of any one of arrangements 103-133.

141. The sterile vial of arrangement 140, wherein the concentrated form of the pharmaceutical antibody formulation is at a concentration of 20, 30, 40, 50, 60, 70, 80, 90, or 100 mg/mL of antibody, or any concentration within a range defined by any two of the aforementioned concentrations.

142. The sterile vial of arrangement 140 or 141, wherein the concentrated form of the pharmaceutical antibody formulation is at a concentration of 20 mg/mL or at least 20 mg/mL of antibody.

143. The sterile vial of any one of arrangements 140-142, wherein the concentrated form of the pharmaceutical antibody formulation is at a concentration of 50 mg/mL or at least 50 mg/mL of antibody.

144. The sterile vial of any one of arrangements 140-143, wherein the concentrated form of the pharmaceutical antibody formulation is intended to be diluted 1×, 2×, 3×, 4×, 5×, 6×, 7×, 8×, 9×, 10×, 11×, 12×, 13×, 14×, 15×, 16×, 17×, 18×, 19×, 20×, 30×, 40×, 50×, 60×, 70×, 80×, 90×, or 100× fold, or any fold within a range defined by any two of the aforementioned fold.

145. The sterile vial of any one of arrangements 140-144, wherein the concentrated form of the pharmaceutical antibody formulation is intended to be diluted to 0.1, 0.2, 0.3, 0.4, 0.5, 0.6, 0.7, 0.8, 0.9, 1, 2, 3, 4, 5, 6, 7, 8, 9, 10, 11, 12, 13, 14, 15, 16, 17, 18, 19, or 20 mg/mL or any concentration within a range defined by any two of the aforementioned concentrations.

146. The sterile vial of any one of arrangements 140-145, wherein the concentrated form of the pharmaceutical antibody formulation is intended to be diluted into a final volume of 200, 210, 220, 230, 240, 250, 260, 270, 280, 290, 300, 310, 320, 330, 340, 350, 360, 370, 380, 390, 400, 410, 420, 430, 440, 450, 460, 470, 480, 490, 500, 510, 520, 530, 540, 550, 560, 570, 580, 590, or 600 mL.

147. The sterile vial of any one of arrangements 140-146, wherein the concentrated form of the pharmaceutical antibody formulation is intended to be diluted with saline.

148. The sterile vial of any one of arrangements 140-147, wherein the pharmaceutical antibody formulation is configured for parenteral administration.

149. The sterile vial of any one of arrangements 140-148, wherein the pharmaceutical antibody formulation is configured for subcutaneous administration.

150. The sterile vial of arrangement 149, wherein the pharmaceutical antibody formulation configured for subcutaneous administration comprises sucrose or mannitol, or both.

151. The sterile vial of any one of arrangements 140-148, wherein the pharmaceutical antibody formulation is configured for intravenous administration.

152. The sterile vial of arrangement 151, wherein the pharmaceutical antibody formulation configured for intravenous administration does not comprise sucrose or mannitol, or both.

153. The sterile vial of any one of arrangements 134-152, wherein the pharmaceutical antibody formulation remains 60% stable over 3 months at either 5° C. or 25° C./60% relative humidity (RH).

154. The pharmaceutical antibody formulation of any one of the preceding pharmaceutical antibody formulation arrangements or sterile vial arrangements, wherein the antibody comprises a heavy chain variable domain (VH) region having a sequence at least 80%, 85%, 90%, 95%, 99%, or 100% identical to that of SEQ ID NO: 298.

155. The pharmaceutical antibody formulation of any one of the preceding pharmaceutical antibody formulation arrangements or sterile vial arrangements, wherein the antibody comprises a light chain variable domain (VL) region having a sequence at least 80%, 85%, 90%, 95%, 99%, or 100% identical to that of SEQ ID NO: 375.

156. The pharmaceutical antibody formulation of any one of the preceding pharmaceutical antibody formulation arrangements or sterile vial arrangements, wherein the antibody comprises a VH region having a sequence at least 80%, 85%, 90%, 95%, 99%, or 100% identical to that of SEQ ID NO: 298, and wherein the antibody comprises a VL region having a sequence at least 80%, 85%, 90%, 95%, 99%, or 100% identical to that of SEQ ID NO: 375.

157. The pharmaceutical antibody formulation of any one of the preceding pharmaceutical antibody formulation arrangements or sterile vial arrangements, wherein the antibody comprises a VH region having a sequence of SEQ ID NO: 298.

158. The pharmaceutical antibody formulation of any one of the preceding pharmaceutical antibody formulation arrangements or sterile vial arrangements, wherein the antibody comprises a VL region having a sequence of SEQ ID NO: 375.

159. The pharmaceutical antibody formulation of any one of the preceding pharmaceutical antibody formulation arrangements or sterile vial arrangements, wherein the antibody comprises a VH region having a sequence of SEQ ID NO: 298, and wherein the antibody comprises a VL region having a sequence of SEQ ID NO: 375.

160. The pharmaceutical antibody formulation of any one of the preceding pharmaceutical antibody formulation arrangements or sterile vial arrangements, wherein the antibody comprises a heavy chain (HC) having a sequence at least 80%, 85%, 90%, 95%, 99%, or 100% identical to that of SEQ ID NO: 449.

161. The pharmaceutical antibody formulation of any one of the preceding pharmaceutical antibody formulation arrangements or sterile vial arrangements, wherein the antibody comprises a light chain (LC) having a sequence at least 80%, 85%, 90%, 95%, 99%, or 100% identical to that of SEQ ID NO: 496.

162. The pharmaceutical antibody formulation of any one of the preceding pharmaceutical antibody formulation arrangements or sterile vial arrangements, wherein the antibody comprises an HC having a sequence of SEQ ID NO: 449.

163. The pharmaceutical antibody formulation of any one of the preceding pharmaceutical antibody formulation arrangements or sterile vial arrangements, wherein the antibody comprises an LC having a sequence of SEQ ID NO: 496.

164. The pharmaceutical antibody formulation of any one of the preceding pharmaceutical antibody formulation arrangements or sterile vial arrangements, wherein the antibody comprises a VH that is encoded by a nucleic acid sequence having at least 80%, 85%, 90%, 95%, 99%, or 100% identical to that of SEQ ID NO: 540.

165. The pharmaceutical antibody formulation of any one of the preceding pharmaceutical antibody formulation arrangements or sterile vial arrangements, wherein the antibody comprises a VL that is encoded by a nucleic acid sequence having at least 80%, 85%, 90%, 95%, 99%, or 100% identical to that of SEQ ID NO: 622.

166. The pharmaceutical antibody formulation of any one of the preceding pharmaceutical antibody formulation arrangements or sterile vial arrangements, wherein the antibody comprises a VH that is encoded by a nucleic acid sequence of SEQ ID NO: 540.

167. The pharmaceutical antibody formulation of any one of the preceding pharmaceutical antibody formulation arrangements or sterile vial arrangements, wherein the antibody comprises a VL that is encoded by a nucleic acid sequence of SEQ ID NO: 622.

168. The pharmaceutical antibody formulation of any one of the preceding pharmaceutical antibody formulation arrangements or sterile vial arrangements, wherein the antibody comprises an HC that is encoded by a nucleic acid sequence having at least 80%, 85%, 90%, 95%, 99%, or 100% identical to that of SEQ ID NO: 704.

169. The pharmaceutical antibody formulation of any one of the preceding pharmaceutical antibody formulation arrangements or sterile vial arrangements, wherein the antibody comprises an LC that is encoded by a nucleic acid sequence having at least 80%, 85%, 90%, 95%, 99%, or 100% identical to that of SEQ ID NO: 751.

170. The pharmaceutical antibody formulation of any one of the preceding pharmaceutical antibody formulation arrangements or sterile vial arrangements, wherein the antibody comprises an HC that is encoded by a nucleic acid sequence of SEQ ID NO: 704.

171. The pharmaceutical antibody formulation of any one of the preceding pharmaceutical antibody formulation arrangements or sterile vial arrangements, wherein the antibody comprises an LC that is encoded by a nucleic acid sequence of SEQ ID NO: 751.

172. A method of treating a coronavirus infection, the method comprising:
administering the pharmaceutical antibody formulation of any one of the preceding pharmaceutical antibody formulation arrangements or sterile vial arrangements to a subject in need of treatment for a coronavirus infection.

173. The method of arrangement 172, wherein the pharmaceutical antibody formulation is administered daily, weekly, bi-weekly, or every 10 days.

174. The method of arrangement 172 or 173, wherein the subject is administered 1 mg, 5 mg, 10 mg, 20 mg, 40 mg, or 50 mg of antibody as a unit dose, or any amount of antibody as a unit dose within a range defined by any two of the aforementioned amounts.

175. The method of any one of arrangements 172-174, wherein the subject is administered a pharmaceutical antibody formulation comprising:
a therapeutically effective amount of the antibody,
wherein the antibody comprises a $V_H$-CDR1 having the sequence of SEQ ID NO: 31, a $V_H$-CDR2 having the sequence of SEQ ID NO: 72, a $V_H$-CDR3 having the sequence of SEQ ID NO: 113, a $V_L$-CDR1 having the sequence of SEQ ID NO: 171, a $V_L$-CDR2 having the sequence of SEQ ID NO: 222; and a $V_L$-CDR3 having the sequence of SEQ ID NO: 249, and wherein the antibody is present at an amount as a unit dose of: 1 mg, 5 mg, 10 mg, 20 mg, 40 mg, or 50 mg;
L-histidine is present at 20 mM;
methionine is present at 5 mM;
NaCl is present at 100 mM;
polysorbate 80 is present at 0.02%; and
the pH is about 5.8.

176. The method of any one of arrangements 172-175, wherein the unit dose is administered over the course of 10, 20, 30, 40, 50, 60, 70, 80, 90, 100, 120, 130, 140, 150, 160, 170, 180, 190, or 200 minutes.

177. The method of any one of arrangements 172-176, wherein the unit dose is administered over the course of 60 minutes.

178. The method of one of arrangements 172-177, further comprising a step of identifying a subject in need of treatment for a coronavirus infection.

179. The method of arrangement 178, wherein the step of identifying the subject in need of treatment for a coronavirus infection comprises one or more of identifying a positive coronavirus infection by PCR test or equivalent test, identifying the subject as having symptoms of fever, cough, sore throat, malaise, headache, muscle pain, gastrointestinal symptoms, shortness of breath with excursion, respiratory rate≥20 breaths per minute, saturation of oxygen (SpO2)>93% on room air at sea level, heart rate≥90 beats per minute, diabetes, hypertension, cancer, chronic kidney disease, body mass index (BMI)≥35, ≥65 years of age, cardiovascular disease such as hypertension, chronic obstructive pulmonary disease or other chronic respiratory disease.

180. The method of one of arrangements 172-179, wherein the treating step is to a patient that already has symptoms of the coronavirus infection.

181. The method of one of arrangements 172-180, wherein the treating step is prophylactic.

182. The method of any one of arrangements 172-181, wherein the coronavirus infection is a SARS-CoV, MERS-CoV, or SARS-CoV-2 infection.

183. The method of any one of arrangements 172-182, wherein the pharmaceutical antibody formulation is administered for 10-18 months.

184. The method of any one of arrangements 172-183, wherein the pharmaceutical antibody formulation is administered intravenously.

185. The method of any one of arrangements 172-184, wherein the pharmaceutical antibody formulation is administered subcutaneously.

186. A pharmaceutical antibody formulation comprising:
a therapeutically effective amount of an antibody, wherein the antibody comprises a $V_H$-CDR1 having the sequence of SEQ ID NO: 31, a $V_H$-CDR2 having the sequence of SEQ ID NO: 72, a $V_H$-CDR3 having the sequence of SEQ ID NO: 113, a $V_L$-CDR1 having the sequence of SEQ ID NO: 171, a $V_L$-CDR2 having the sequence of SEQ ID NO: 222; and a $V_L$-CDR3 having the sequence of SEQ ID NO: 249, wherein each CDR can have up to 1, 2, 3, 4, or 5 amino acids changed from the recited sequence;
histidine;
methionine;
NaCl; and
polysorbate, wherein the formulation is at a pH between 5.3 and 6.3.

187. The pharmaceutical antibody formulation of arrangement 186, further comprising sucrose or mannitol, or both.

188. The pharmaceutical antibody formulation of arrangement 186 or 187, wherein the antibody is present at an amount as a unit dose of: 1 mg, 5 mg, 10 mg, 20 mg, 40 mg, or 50 mg.

189. A method of treating a coronavirus infection, the method comprising:
administering a pharmaceutical antibody formulation to a subject in need of treatment for a coronavirus infection, wherein the pharmaceutical antibody formulation comprises a therapeutically effective amount of an antibody, wherein the antibody comprises a $V_H$-CDR1 having the sequence of SEQ ID NO: 31, a $V_H$-CDR2 having the sequence of SEQ ID NO: 72, a $V_H$-CDR3 having the sequence of SEQ ID NO: 113, a $V_L$-CDR1 having the sequence of SEQ ID NO: 171, a $V_L$-CDR2 having the sequence of SEQ ID NO: 222; and a $V_L$-CDR3 having the sequence of SEQ ID NO: 249;
histidine;
methionine;
NaCl; and
polysorbate, wherein the formulation is at a pH between 5.3 and 6.3.

190. A method of decreasing or inhibiting inflammation in a subject in need thereof, the method comprising:
administering a pharmaceutical antibody formulation to the subject in need thereof,
wherein the pharmaceutical antibody formulation comprises a therapeutically effective amount of an antibody, wherein the antibody comprises a $V_H$-CDR1 having the sequence of SEQ ID NO: 31, a $V_H$-CDR2 having the sequence of SEQ ID NO: 72, a $V_H$-CDR3 having the sequence of SEQ ID NO: 113, a $V_L$-CDR1 having the sequence of SEQ ID NO: 171, a $V_L$-CDR2 having the sequence of SEQ ID NO: 222; and a $V_L$-CDR3 having the sequence of SEQ ID NO: 249;
histidine;
methionine;
NaCl; and
polysorbate, wherein the formulation is at a pH between 5.3 and 6.3.

EXAMPLES

Some aspects of the embodiments discussed above are disclosed in further detail in the following examples, which are not in any way intended to limit the scope of the present disclosure. Those in the art will appreciate that many other embodiments also fall within the scope of the invention, as it is described herein above and in the claims.

Example 1. Evaluation of Gal3 mRNA Expression in COVID-19 (SARS-CoV-2 Patient Samples To evaluate the relative Gal3 mRNA levels in PBMCs collected from blood of SARS-CoV-2-infected patients, reported Gal3 mRNA (LGALS3) expression by RNA sequencing was extracted from Xiong Y., et al. Transcriptomic characteristics of bronchoalveolar lavage fluid and peripheral blood mononuclear cells in COVID-19 patients. *Emerging Microbes & Infections*, 2020; 9(1):761-770, hereby incorporated by reference in its entirety. Data from three normal donors and three SARS-CoV-2 patients was evaluated. The extracted data are reproduced in Table 1 below. FIG. 1 shows a graphical representation of this relative Gal3 mRNA expression data as generated employing R software (available on the world wide web at r-project.org).

TABLE 1

Gal3 expression profile in COVID-19 patients

| Healthy Controls | Counts per million (CPM) | COVID-19 Patients | Counts per million (CPM) |
|---|---|---|---|
| Individual 1 | 54.95 | Individual 1 | 108.12 |
| Individual 2 | 64.85 | Individual 2 | 179.4 |
| Individual 3 | 53.94 | Individual 3 | 150.39 |
| Average CPM | 57.91 | Average CPM | 145.97 |
| Log2 Fold Change | 1.54 | | |
| p-value | $4.26 \times 10^{-4}$ | | |

Example 2. Assessment of Gal3 Binding to Coronavirus Host Entry Receptor Proteins To evaluate the possibility that Gal3 could physically interact with human receptors mediating coronavirus entry into host cells, such as angiotensin-converting enzyme 2 (ACE2) and CD147 (EMMPRIN, basigin), ELISA assessments using purified Gal3 and purified ACE2 and CD147 were conducted.

Briefly, human Gal3 protein (R&D Systems, 8259-GA; R&D Systems, 1154-GA/CF; or Acro Biosystems, GA3-H5129) was diluted in PBS (Corning, 21-030-CM) to a concentration of 4, 2, or 1 µg/ml and added to the wells of a 96-well ELISA plate (Thermo Fisher, 44-2404-21). After incubating the plate at 4° C. overnight, the plate was washed three times with PBST (PBS with 0.05% Tween 20 [VWR, 0777]). The plate was then blocked for an hour with 2% BSA (EMD Millipore, 126609) in PBST at room temperature with gentle rocking. Thereafter, the 2% BSA in PBST was discarded and 4, 2, or 1 µg/ml of recombinant host entry receptor proteins in 2% BSA in PBST were added to the wells. The host entry receptor proteins used include recombinant human ACE2 (hACE2; LifeSpan Biosciences, LS-G97114-10, hIgG1 Fc-tagged; or Acro Biosystems, AC2-H82F9, biotinylated) and CD147 (hCD147; R&D Systems, 972-EMN, 6× His-tagged). The plate was incubated for an hour at room temperature with gentle rocking. Thereafter, the plate was washed three times with PBST. Peroxidase AffiniPure F(ab')2 Fragment Goat Anti-Human IgG (H+L) polyclonal antibody (Jackson ImmunoResearch, 109-036-003; 1:4000 dilution; detects ACE2 from LifeSpan Biosciences), Avidin HRP (Biolegend, 405103; 1:2000 dilution, detects ACE2 from Acro Biosystems), or goat anti-6× His HRP antibody (Abcam, ab1269; 1:3000 dilution, detects CD147) was diluted in 2% BSA in PBST and added to the wells. The plate was incubated at room temperature for an hour with gentle rocking and then washed three times with PBST. TMB substrate (Thermo Scientific, 34029) was then added to each well. The reaction was stopped with 1M HCl (JT Baker, 5620-02) and read using a plate reader (Molecular Devices) at absorbance of 450 nm.

Figure 2:
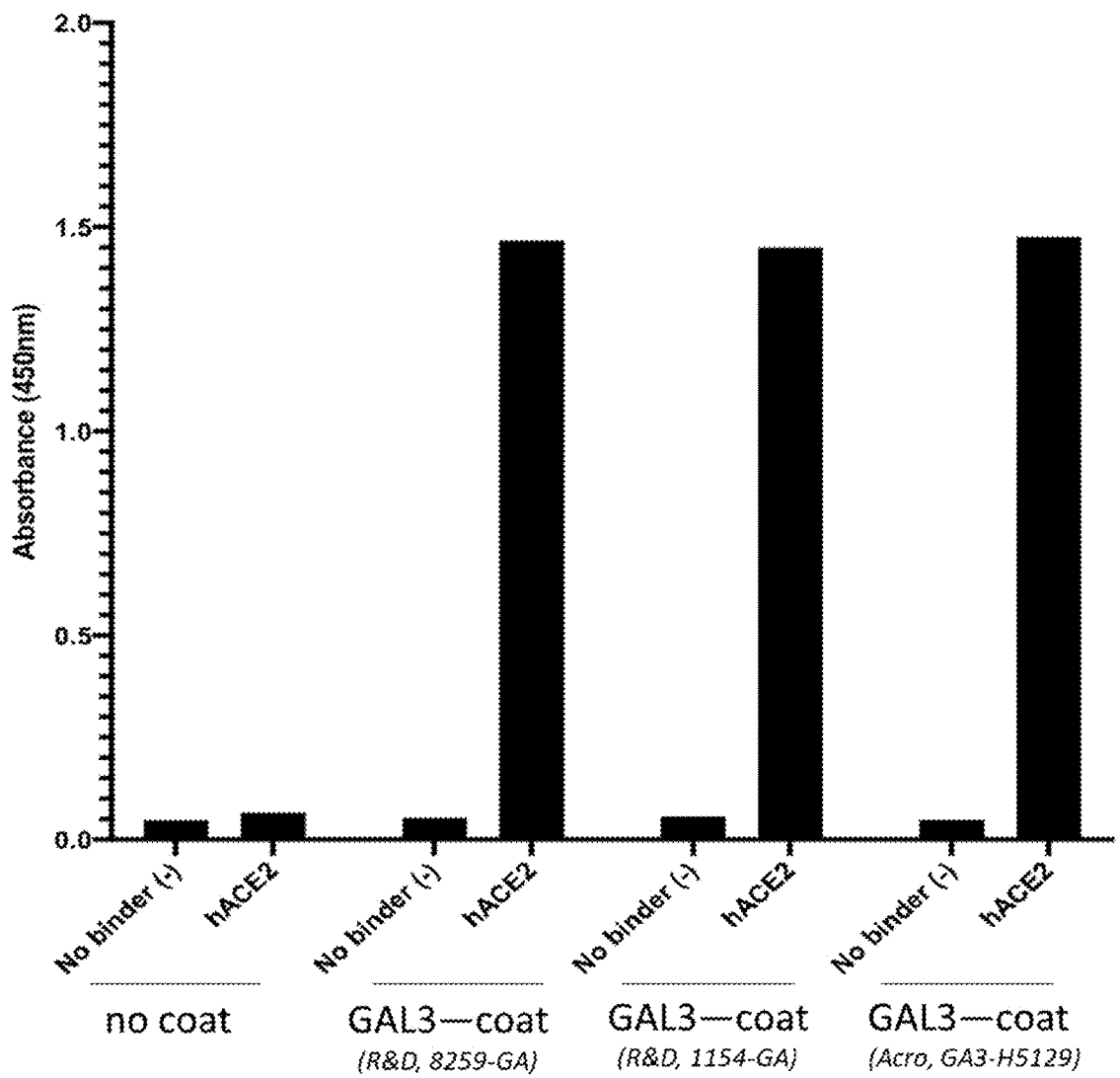
FIG. 2 depicts a graphical representation of the assessment of relative binding affinity of hACE2 protein to Gal3 obtained from different vendors as measured by ELISA.
Figure 3:
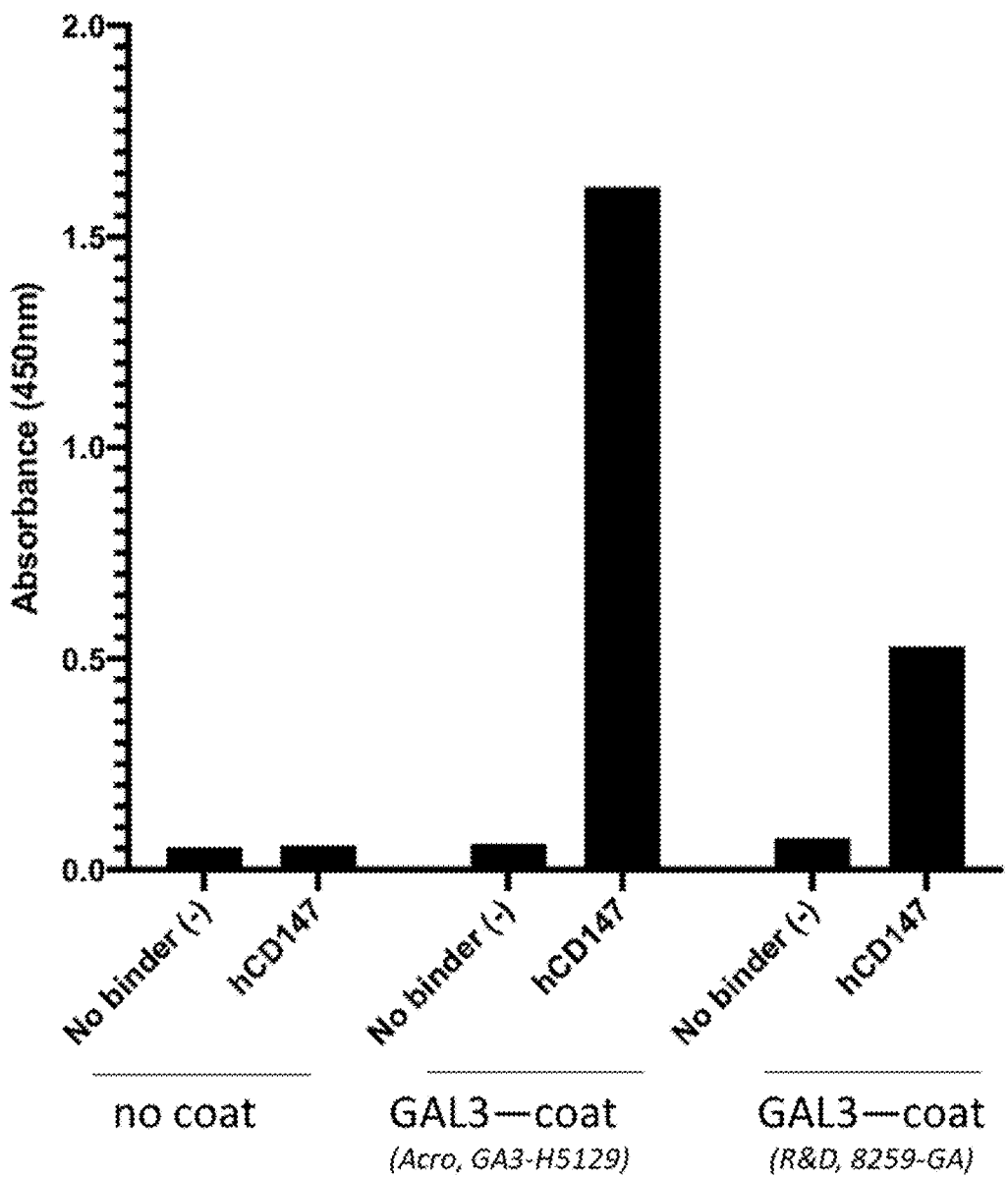
FIG. 3 depicts a graphical representation of the assessment of relative binding affinity of hCD147 protein to Gal3 obtained from different vendors as measured by ELISA.

As depicted in FIG. 2 and FIG. 3, no significant binding of the ACE2 or CD147 was observed to plates without Gal3 coating. In contrast, both host entry receptors strongly bound Gal3-coated wells. To ensure reproducibility of this observation, human Gal3 from different vendors was tested.

Example 3. Assessment of Gal3 Binding to Coronavirus Spike Protein

To evaluate the possibility that human Gal3 could physically interact with SARS-CoV-2 spike protein (S protein), which mediates coronavirus entry into host cells, ELISA assessment with purified Gal3 and SARS-CoV-2 S protein was conducted. Briefly, human Gal3 protein (R&D Systems, 1154-GA/CF or Acro Biosystems, GA3-H5129) was diluted in PBS (Corning, 21-030-CM) to a concentration of 4, 2, or 1 µg/ml and added to the wells of a 96-well ELISA plate (Thermo Fisher, 44-2404-21). After incubating the plate at 4° C. overnight, the plate was washed three times with PBST (PBS with 0.05% Tween 20 [VWR, 0777]). The plate was then blocked for an hour with 2% BSA (EMD Millipore, 126609) in PBST at room temperature with gentle rocking. During blocking, SARS-CoV-2 S protein (Acro Biosystems, SPN-C52H4) was biotinylated with EZ Link Sulfo-NHS-LC-Biotin (ThermoFisher Scientific, A39257), following manufacturer's instructions. After biotinylation, the protein was desalted using a Zeba Spin Desalting Column (ThermoFisher Scientific, 89882), following manufacturer's instructions. Thereafter, the 2% BSA in PBST was discarded and 4, 2, or 1 µg/ml of non-biotinylated or biotinylated recombinant SARS-CoV-2 S protein in 2% BSA in PBST was added to the wells. The plate was incubated for an hour at room temperature with gentle rocking. Thereafter, the plate was washed three times with PBST. Anti-6× His HRP antibody (Abcam, ab1269; 1:3000 dilution) or Avidin HRP (Biolegend, 405103; 1:2000 dilution) was diluted in 2% BSA in PBST and then added to the wells. The plate was incubated at room temperature for an hour with gentle rocking and then washed three times with PBST. TMB substrate (Thermo Scientific, 34029) was then added to each well. The reaction was stopped with 1M HCl (JT Baker, 5620-02) and read using a plate reader (Molecular Devices) at absorbance of 450 nm.

Figure 4:
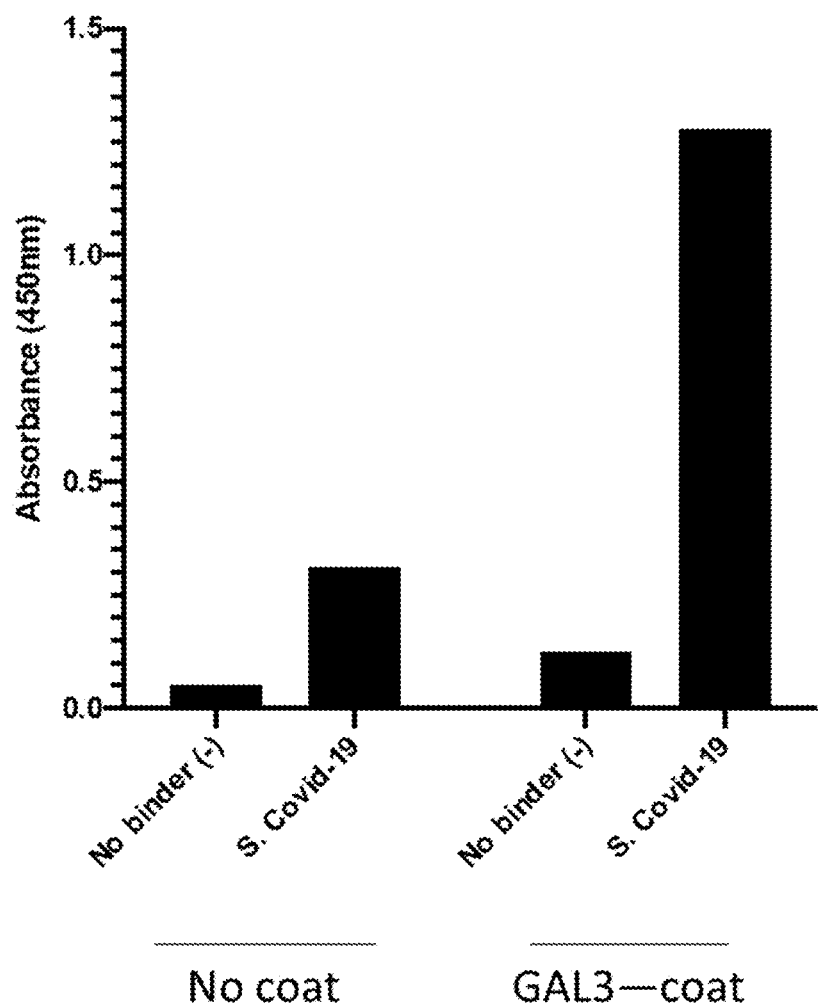
FIG. 4 depicts a graphical representation of the assessment of relative binding affinity of spike (S) protein of SARS-CoV-2 protein to Gal3 as measured by ELISA.

As depicted in FIG. 4, no significant binding of the SARS-CoV-2 S protein was observed to plates without Gal3 coating. In contrast, SARS-CoV-2 S protein strongly bound Gal3-coated wells.

Figure 5A:
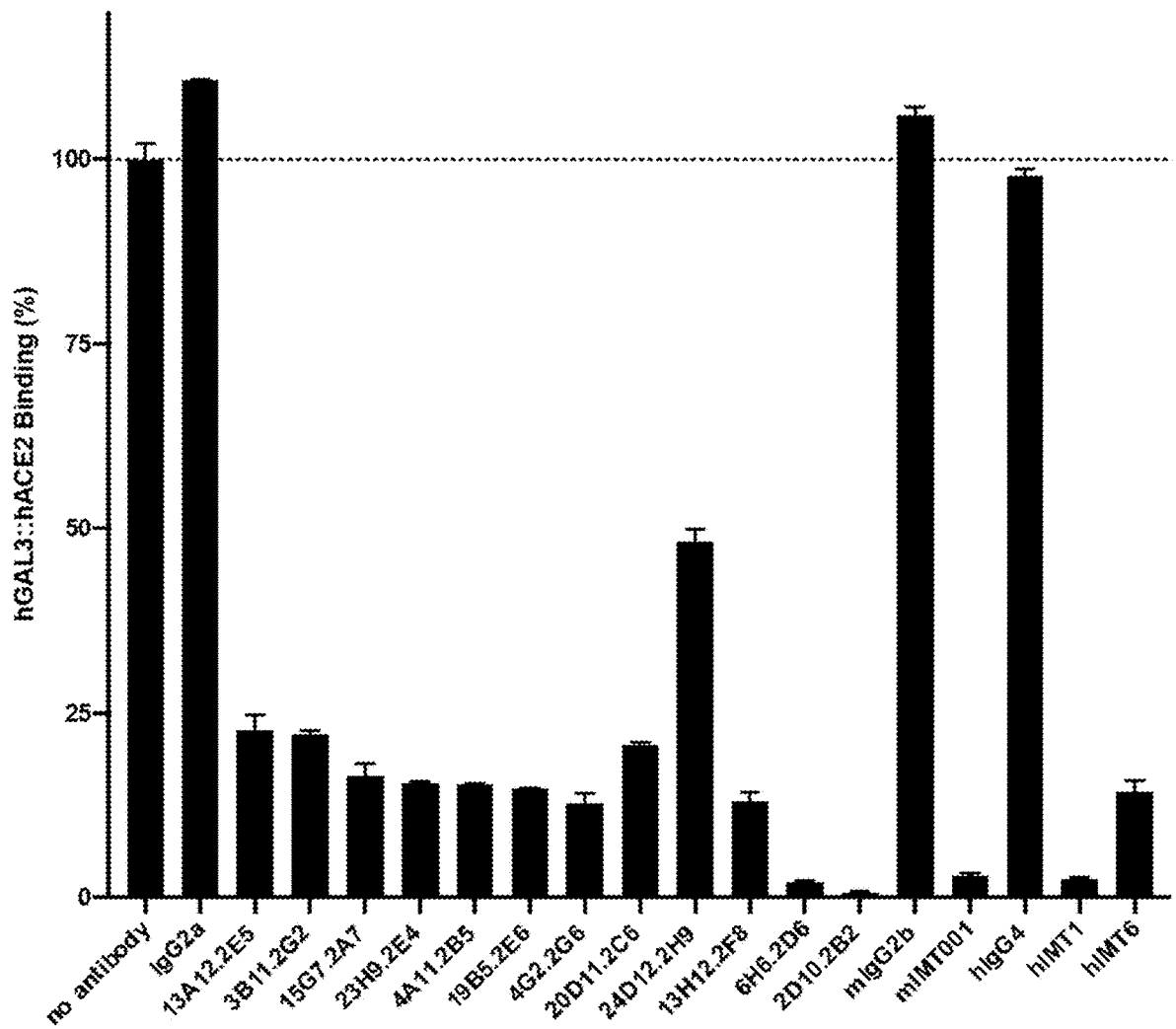
FIG. 5A depicts a graphical representation of the assessment of relative binding affinity of hACE2 to Gal3 following blockade by anti-Gal3 antibodies as measured by ELISA.

Example 4. Anti-Gal3 Antibodies Targeted to the N-Terminal Domain or TRD Blocks Binding of Gal3 to Coronavirus Host Entry Receptors To identify Gal3-binding antibodies with the capacity to block the assembly of Gal3 with human receptors mediating coronavirus entry into host cells, purified Gal3 and human ACE2 (hACE2) were incubated in the presence of a panel of Gal3-targeted monoclonal antibodies, with non-specific control antibodies, or without antibody, and protein interaction was evaluated by ELISA. Briefly, human Gal3 protein (Acro Biosystems, GA3-H5129) was diluted in PBS to a concentration of 1.5 μg/ml and added to the wells of a 96-well ELISA plate. After incubating the plate at 4° C. overnight, the plate was washed three times with PBST. The plate was then blocked for an hour with 2% BSA in PBST at room temperature with gentle rocking. Thereafter, the 2% BSA in PBST was discarded and 30 μl of control or anti-Gal3 antibodies at 20 μg/ml were added to each well, followed by the addition of 30 μl of 3 μg/ml of biotinylated host entry receptor hACE2 (Acro Biosystems, AC2-H82F9). The plate was incubated for an hour at room temperature with gentle rocking. Thereafter, the plate was washed three times with PBST. Avidin HRP (Biolegend, 405103) was then added to the wells at 1:2000 dilution in 2% BSA in PBST. The plate was incubated at room temperature for an hour with gentle rocking and then washed three times with PBST. TMB substrate was then added to each well. The reaction was stopped with 1M HCl and read using a plate reader at absorbance of 450 nm.

As depicted in FIG. 5A, antibodies targeted to the N-terminal domain or TRD of Gal3 exhibited a range of inhibitory activity against the binding of Gal3 to the host entry receptor protein ACE2. Several antibody clones, 2D10.2B2, 6H6.2D6, murine IMT1 (mIMT1, mIMT001), and human IMT1 (hIMT1, IMT001) displayed over 95% blocking of GAL3 assembly with ACE2. In contract, 24D12.2H9 antibody demonstrated only 55% of blocking activity. The rest of the tested antibodies (13A12.2E5, 3B11.2G2, 13H12.2F8, 23H9.2E4, 4A11.2B5, 19B5.2E6, 15G7.2A7, 4G2.2G6, 20D11.2C6, human IMT6 (IMT006, IMT006a)) displayed between 75-90% of blocking of GAL3 assembly with ACE2. Collectively, these observations reveal that Gal3-targeted antibodies exist with varying ability in interfering with the association of Gal3 with the host entry receptor ACE2.

Example 5. Anti-Gal3 Antibodies Targeted to the N-Terminal Domain or TRD Blocks Binding of Gal3 to Coronavirus Spike Protein To identify Gal3-binding antibodies with the capacity to block the assembly of Gal3 with SARS-CoV-2 spike protein (S protein), purified Gal3 and SARS-CoV-2 S protein were incubated in the presence of a panel of Gal3-targeted monoclonal antibodies, with non-specific control antibodies, or without antibody, and protein interaction was evaluated by ELISA.

Human Galectin-3 protein (Immutics, HEK293 6his-EK-hGal3 E1) was diluted in PBS to a concentration of 4 µg/ml and 40 µl was added to the wells of an ELISA plate. After incubating the plate at 4° C. overnight, the plate was washed three times with 300 µl PBST (PBS with 0.05% Tween 20). The plate was then blocked for an hour with 150 µl 2% BSA in PBST at room temperature with gentle rocking. SARS-CoV-2 spike RBD (GenScript, Z03483-1, P50172004) was biotinylated with EZ-Link Sulfo-NHS-LC-Biotin (ThermoFisher Scientific, A39257) following the manufacturer's instructions and desalted using Zeba Spin Desalting Columns (ThermoFisher Scientific, 89882) following the manufacturer's instructions. Thereafter, the 2% BSA in PBST was discarded and 30 µl of antibody (20 µg/ml) in 2% BSA in PBST in duplicate was added to the wells. Immediately afterwards, 30 µl of biotinylated SARS-CoV-2 spike RBD (2 µg/ml) in 2% BSA in PBST was added to the antibody in the wells. The plate was incubated for an hour at room temperature with gentle rocking. Thereafter, the plate was washed three times with 300 µl PBST. Avidin HRP (1:2000) was diluted in 2% BSA in PBST and then 30 µl added to the wells. The plate was incubated at room temperature for an hour with gentle rocking and then washed three times with 300 µl PBST. TMB substrate (50 µl) (Thermo Scientific, 34029, UJ2859151) was then added to each well. The reaction was stopped with 1N HCl (25 µl) and read using a plate reader at absorbance of 450 nm.

Figure 5B:
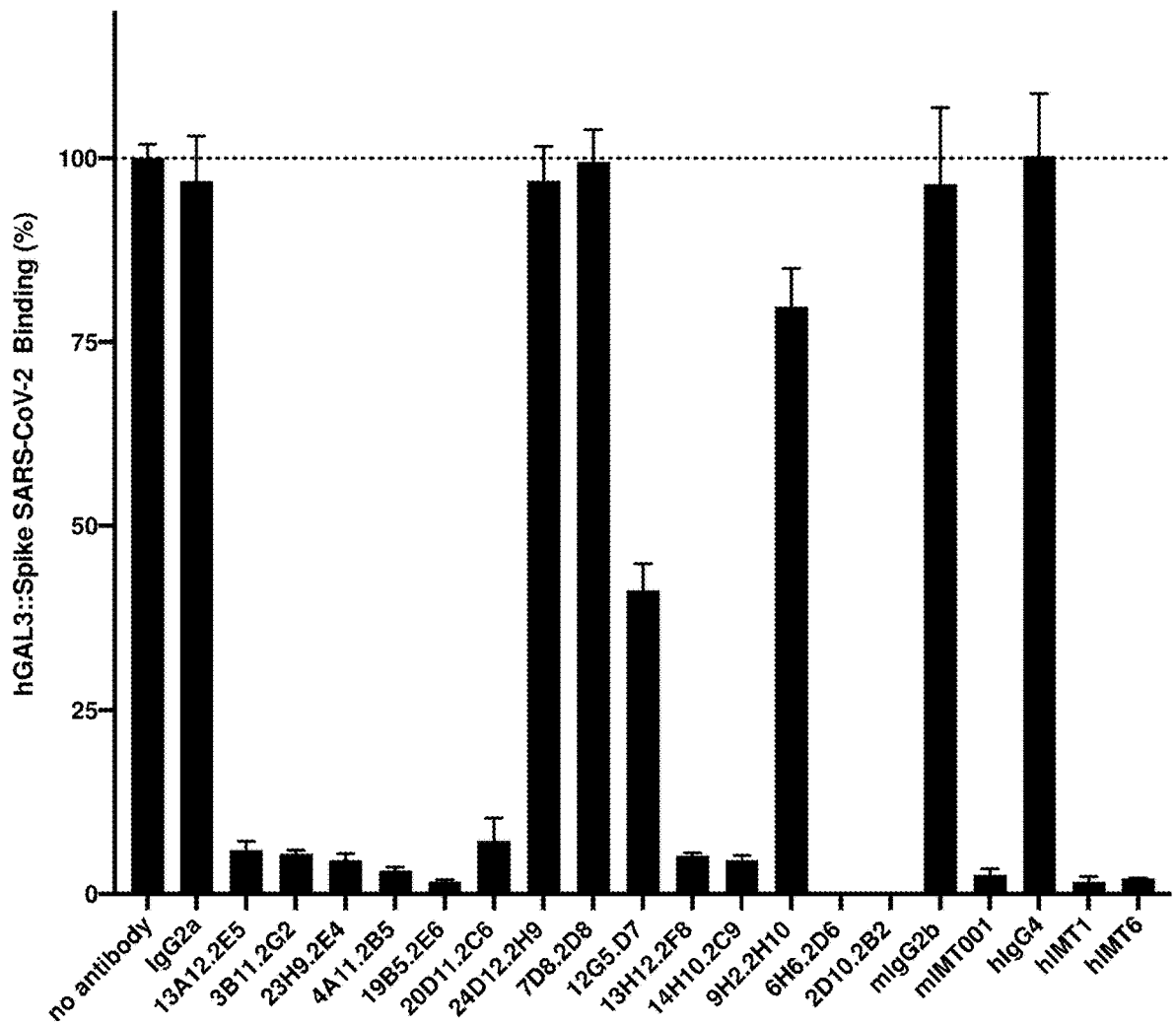
FIG. 5B depicts a graphical representation of the assessment of relative binding affinity of spike (S) protein of SARS-CoV-2 protein to Gal3 following blockade by anti-Gal3 antibodies as measured by ELISA.

As depicted in FIG. 5B, antibodies targeted to the N-terminal domain or TRD of Gal3 exhibited a range of inhibitory activity against the binding of Gal3 to SARS-CoV-2 spike protein. Antibody 2D10.2B2, 6H6.2D6 completely inhibited GAL3 assembly with coronavirus spike protein. The majority of the tested antibodies (13A12.2E5, 3B11.2G2, 13H12.2F8, 23H9.2E4, 4A11.2B5, 19B5.2E6, 20D11.2C6, 14H10.2C9, human IMT6 (IMT006, IMT006a), murine IMT1 (mIMT1, mIMT001), and human IMT1 (hIMT1, IMT001) displayed at least 90% of blocking of GAL3 assembly with coronavirus spike protein. In contract, 24D12.2H9 and 7D8.2D8 antibody did not block GAL3 interaction with SARS-CoV-2 spike protein. Additional antibody clones (12G5.D7 and 9H2.2H10) displayed 45-75% of blocking activity. Collectively, these observations reveal that Gal3-targeted antibodies exist with varying ability in interfering with the association of Gal3 with coronavirus spike protein.

Example 6. Anti-Gal3 Antibodies Targeted to the N-Terminal Domain or TRD Reduces Coronavirus Load In Vivo Patients present with an active SARS-CoV-2 infection. One or more anti-Gal3 antibodies or binding fragments thereof are administered to the patients enterally, orally, intranasally, parenterally, subcutaneously, intramuscularly, intradermally, or intravenously.

The anti-Gal3 antibodies or binding fragments thereof are administered as doses at an amount of 1 ng as a unit dose (or in the alternative, an amount of 10, 100, 1000 ng, or 1, 10, 50, 100, 200, 300, 400, 500, 600, 700, 800, 900, 1000 µg, or 1, 10, 100, 200, 300, 400, 500, 600, 700, 800, 900, 1000 mg as a unit dose, or any amount within a range defined by any two of the aforementioned amounts, or any other amount appropriate for optimal efficacy in humans). The doses are administered every 1 day (or in the alternative, every 2, 3, 4, 5, 6, 7, 8, 9, 10, 11, 12, 24, 36, or 48 days or weeks or any time within a range defined by any two of the aforementioned times).

A reduction in viral load or viral count in a nasal swab sample, saliva sample, or bronchoalveolar lavage sample is observed in the patients following administration of the anti-Gal3 antibodies or binding fragments thereof.

Administration of the anti-Gal3 antibodies or binding fragments may be performed in conjunction with another antiviral or anti-inflammatory therapy. Potential antiviral or anti-inflammatory therapeutics may include but are not limited to chloroquine, hydroxychloroquine, favipiravir, favilavir, remdesivir, tocilizumab, baricitinib, acalabrutinib, galidesivir, sarilumab, lopinavir, ritonavir, darunavir, ribavirin, dexamethasone, ciclesonide, convalescent plasma, interferon-α, pegylated interferon-α, or interferon alfa-2b, or any combination thereof. Patients will be monitored for side effects such as dizziness, nausea, diarrhea, depression, insomnia, headaches, itching, rashes, fevers, or other known side effects of the provided antiviral therapeutics.

Example 7. Anti-Gal3 Antibodies Targeted to the N-Terminal Domain or TRD Reduces Pulmonary Fibrosis Caused by a Prior SARS-CoV-2 Infection Patients present with pulmonary fibrosis as a sequela of a prior SARS-CoV-2 infection. One or more anti-Gal3 antibodies or binding fragments thereof are administered to the patients enterally, orally, intranasally, parenterally, subcutaneously, intramuscularly, intradermally, or intravenously.

The anti-Gal3 antibodies or binding fragments thereof are administered as doses at an amount of 1 ng as a unit dose (or in the alternative, an amount of 10, 100, 1000 ng, or 1, 10, 50, 100, 200, 300, 400, 500, 600, 700, 800, 900, 1000 µg, or 1, 10, 100, 200, 300, 400, 500, 600, 700, 800, 900, 1000 mg as a unit dose, or any amount within a range defined by any two of the aforementioned amounts, or any other amount appropriate for optimal efficacy in humans. The doses are administered every 1 day (or in the alternative, every 2, 3, 4, 5, 6, 7, 8, 9, 10, 11, 12, 24, 36, or 48 days or weeks or any time within a range defined by any two of the aforementioned times).

A reduction in fibrotic tissue is observed in the patients following administration of the anti-Gal3 antibodies or binding fragments thereof. An improvement to other sequelae of the SARS-CoV-2 infection, including but not limited to another fibrosis, pulmonary edema, cardiovascular disease, thrombosis, neurological disease, kidney disease, or liver disease may be also seen.

Administration of the anti-Gal3 antibodies or binding fragments may be performed in conjunction with another antiviral or anti-inflammatory therapy. Potential antiviral or anti-inflammatory therapeutics may include but are not limited to chloroquine, hydroxychloroquine, favipiravir, favilavir, remdesivir, tocilizumab, baricitinib, acalabrutinib, galidesivir, sarilumab, lopinavir, ritonavir, darunavir, ribavirin, dexamethasone, ciclesonide, convalescent plasma, interferon-α, pegylated interferon-α, or interferon alfa-2b, or any combination thereof. Patients will be monitored for side effects such as dizziness, nausea, diarrhea, depression, insomnia, headaches, itching, rashes, fevers, or other known side effects of the provided antiviral therapeutics.

Example 8. Anti-Gal3 Antibodies Targeted to the N-Terminal Domain or TRD Reduces Cytokine Release Syndrome Patients present with cytokine release syndrome (CRS, cytokine storm) and other inflammatory symptoms including but not limited to fever, headache, myalgia, arthralgia, fatigue, nausea, diarrhea, dermatitis, tachycardia, hypotension, hypoxia, tachypnea, pulmonary edema, azotemia, transaminitis, hyperbilirubinemia, or organ failure. In some alternatives, the CRS is a result of another disease, infection or condition. In some alternatives, the CRS is a result of a bacterial infection. In some alternatives, the CRS is a result of sepsis. In some alternatives, the CRS is a result of CAR T therapy. In some alternatives, the CRS is a result of a viral infection. In some alternatives, the CRS is a result of a coronavirus infection. In some alternatives, the CRS is a result of a SARS-related coronavirus infection. In some alternatives, the CRS is a result of a SARS-CoV-2 virus infection. In some alternatives, the CRS is a result of sepsis caused by a viral infection. In some alternatives, the CRS is a result of sepsis caused by a coronavirus infection. In some alternatives, the CRS is a result of sepsis caused by a SARS-related coronavirus infection. In some alternatives, the CRS is a result of sepsis caused by a SARS-CoV-2 virus infection. One or more anti-Gal3 antibodies or binding fragments thereof described herein are administered to the patients enterally, orally, intranasally, parenterally, subcutaneously, intramuscularly, intradermally, or intravenously.

The anti-Gal3 antibodies or binding fragments thereof are administered as doses at an amount of 1 ng as a unit dose (or in the alternative, an amount of 10, 100, 1000 ng, or 1, 10, 50, 100, 200, 300, 400, 500, 600, 700, 800, 900, 1000 kg, or 1, 10, 100, 200, 300, 400, 500, 600, 700, 800, 900, 1000 mg as a unit dose, or any amount within a range defined by any two of the aforementioned amounts, or any other amount appropriate for optimal efficacy in humans. The doses are administered every 1 day (or in the alternative, 2, 3, 4, 5, 6, 7, 8, 9, 10, 11, 12, 24, 36, or 48 days or weeks or any time within a range defined by any two of the aforementioned times).

A reduction of symptoms related to CRS is observed in the patient following administration of the anti-Gal3 antibodies or binding fragments thereof.

Figure 21:
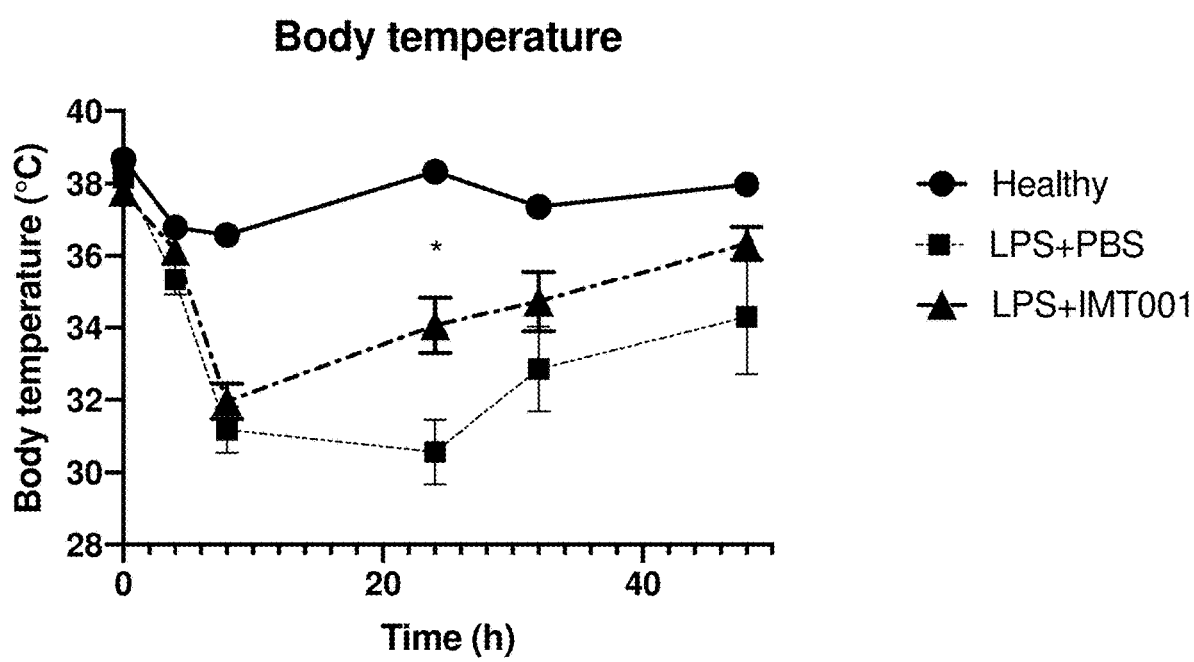
FIG. 21 depicts a graphical representation of body temperature of LPS-treated mice when further treated with either PBS control or the anti-Gal3 antibody IMT001. Mice treated with IMT001 experienced amelioration of LPS-induced hypothermia.

To validate the outcome of anti-Gal3 antibody treatment on the wellbeing of animals with severe CRS, eight-week-old male C57BL/6 mice (Jackson Laboratory) were injected i.p. with 10 mg/kg of LPS (Sigma, *Escherichia coli* 0127: B8; Cat: L3129-100MG) to induce sepsis. In most severe sepsis cases, systemic inflammation is accompanied by a drop in body temperature (hypothermia). LPS-treated mice were divided into two groups for treatments (PBS, n=9 vs. hIMT001 (human IMT001), n=10). LPS-treated mice received two doses of hIMT001 antibody (10 mg/kg, i.p.) or vehicle control (PBS) after one hour and 25 hours following LPS injection. Five healthy C57BL/6 animals were used as a control. Body weight, body temperature by rectal thermometer and clinical observation were monitored for forty-eight hours. Mice treated with LPS and PBS experienced substantial hypothermia, agreeing with evidence that LPS can cause systemic inflammation and hypothermia to mice. However, hIMT001 was able to significantly reverse the hypothermia compared to the PBS-treated group (FIG. 21). Multiple t-tests were used to compare PBS vs. hIMT001 in LPS-treated mice at different time points. (*) p=0.008047 at 24 hours after LPS injection.

Administration of the anti-Gal3 antibodies or binding fragments may be performed in conjunction with another antiviral or anti-inflammatory therapy. Potential antiviral or anti-inflammatory therapeutics may include but are not limited to chloroquine, hydroxychloroquine, favipiravir, favilavir, remdesivir, tocilizumab, baricitinib, acalabrutinib, galidesivir, sarilumab, lopinavir, ritonavir, darunavir, ribavirin, dexamethasone, ciclesonide, convalescent plasma, interferon-α, pegylated interferon-α, or interferon alfa-2b, anti-cytokine antibodies, angiotensin-converting enzyme inhibitors, angiotensin II receptor blockers, corticosteroids, free radical scavengers, TNF-α blockers or any combination thereof. Patients will be monitored for side effects such as dizziness, nausea, diarrhea, depression, insomnia, headaches, itching, rashes, fevers, or other known side effects of the provided antiviral therapeutics.

Example 9. Gal3-Targeted Antibodies Bind to Distinct Epitopes of Gal3

To identify the epitopes to which Gal3 antibodies bound, a library of 20 amino acid peptides representing portions of Gal3, summarized in FIG. 7, was produced and the ability to bind Gal3 antibodies was evaluated by ELISA.

At least 2 μg/ml of hGal3 peptide in 50 μl of PBS or 0.1 μg/ml of full-length human Gal3 protein (GenScript or Acro Biosystems, GA3-H5129) were diluted in PBS (Corning, 21-030-CM) to concentrations of at least 2 μg/ml or 0.1 μg/ml, respectively, and added to the wells of a 96-well ELISA plate (Thermo Fisher, 44-2404-21). After incubating the plate at 4° C. overnight, the plate was washed three times with PBST (PBS with 0.05% Tween 20 [VWR, 0777]). The plate was then blocked for an hour with 2% BSA (EMD Millipore, 126609) in PBST at room temperature with gentle rocking. Thereafter, the 2% BSA in PBST was discarded and human Gal3 hybridoma supernatants or antibodies were diluted in 2% BSA in PBST to concentrations of at least 0.1 μg/ml and added to the wells. The plate was incubated for an hour at room temperature with gentle rocking and then washed three times with PBST. Afterwards, Goat Anti-Mouse IgG-HRP (Jackson ImmunoResearch, 115-036-1461) or Goat Anti-Rat IgG HRP (Abcam, ab205720) diluted in 2% BSA in PBST (1:4000) were added to the wells. The plate was incubated for 30 minutes to 1 hour at room temperature with gentle rocking and then washed three times with PBST. TMB substrate (Thermo Scientific, 34029) was then added to each well. The reaction was stopped with 1M HCl (JT Baker, 5620-02) and read using a plate reader (Molecular Devices) at absorbance of 450 nm.

Binding of Gal3-binding antibodies to the peptide array was observed at multiple locations, with the majority of binding observed in peptides 1-8, summarized in FIG. 7. Six separate Gal3-binding antibodies (6H6.2D6, 20H5.A3, 20D11.2C6, 19B5.2E6, 15G7.2A7, 23H9.2E4) all bound peptide 1 of Gal3, corresponding to amino acids 1-20 of Gal3, ADNFSLHDALSGSGNPNPQG (SEQ ID NO: 3). Similarly, three separate Gal3-binding antibodies (4G2.2G6, 3B11.2G2, and 13A12.2E5) bound peptide 4 of Gal3, corresponding to amino acids 31-50 of Gal3, GAGGYPGASYPGAYPGQAPP (SEQ ID NO: 6). Further, eleven Gal3-binding antibodies (IMT001, 846T.1H2, 13H12.2F8, 19D9.2E5, 14H10.2C9, 2D10.2B2, 4A11.2B5, 846.2H3, 846.1F5, 3B11.2D2, and 13A12.2E5) all bound peptide 6 of Gal3, corresponding to amino acids 51-70 of Gal3, GAYPGQAPPGAYPGAPGAYP (SEQ ID NO: 8). Additionally, twelve Gal3-binding antibodies (6H6.2D6, 20H5.A3, 20D11.2C6, 13H12.2F8, 19B5.2E6, 23H9.2E4, 15G7.2A7, 19D9.2E5, 14H10.2C9, 7D8.2D8, 15F10.2D6 and 846.14A2) all bound peptide 7 of Gal3, corresponding to amino acids 61-80 of Gal3, AYPGAPGAYPGAPAPGVYPG (SEQ ID NO: 9).

As illustrated in FIG. 7, peptides 4, 5, 6, and 7 share repeated amino acid sequences comprised of proline-glycine (PG) and tyrosine-proline-glycine (YPG), indicating a common feature that may explain the ability of Gal3-targeted antibodies to bind to multiple Gal3 peptides. Further, the amino acid sequence glycine-x-tyrosine-proline-glycine (GxYPG) (SEQ ID NO: 840), where x may be the amino acids alanine (A), glycine (G), or valine (V), is shared in peptides 4, 6, and 7, each of which possess two such sequences separated by 3 amino acids. Accordingly, the presence of two GxYPG (SEQ ID NO: 840) sequences in close apposition is likely predictive of the ability to bind Gal3-targeted antibodies. Additionally, the Grantham distance of alanine, glycine, and valine is Ala-Val: 64, Ala-Gly: 60, Val-Gly: 109, thereby predicting that amino acids with similarly low Grantham distances may similarly be able to substitute at the variable region, including proline and threonine.

Example 10. Humanized Anti-Gal3 Antibodies have High Affinity for Gal3 of Different Species Humanized IMT001 and IMT006a, which were derived from mouse mAbs, both have high affinity for human (IMT001: 3.6 nM, IMT006a: 8.9 nM) and cynomolgus (IMT001: 8.9 nM, IMT006a: 5.1 nM) Gal3 (FIG. 20). IMT001 also has high affinity for mouse Gal3 (IMT001: 2.3 nM, IMT006a: 40000 nM) and rat Gal3 (IMT001: 14 nM, IMT006a: undetected).

Example 11. The Amino-Terminal Domain of Gal3 Promotes Activation of Neutrophils To determine if Gal3 mediates activation of neutrophils and which domain might be implicated, wild-type Gal3 (Gal3 WT) was compared to Gal3 with changes in the N-terminal domain: a truncation from residues 1-64 (Gal3 Cut; Gal3C) and a proline-to-histidine point mutation at residue 64 (P64H; Gal3 Mut).

HL60 promyelocytic cells (ATCC, #CCL-240) were stimulated for three days with 1.3% DMSO to differentiate the cell line into neutrophils (as in Milius and Weiner, Meth. Mol. Biol. 591:147-158 (2010), hereby incorporated by reference in its entirety). $2 \times 10^5$ cells were then plated in 200 µL serum-free media on a 96 well plate in duplicate for each condition. One plate was set up for each of two time points (30 minutes and 4 hours). Gal3 WT (TrueBinding, QC200361), Gal3 Cut (truncated version of Gal3 (AA 65-251), TrueBinding, QCB200349), and Gal3 Mut (mutated version of Gal3 (P64H), TrueBinding, QC200359) at 4, 2, 1, 0.5, 0.1, or 0 µM were added to cells. After 30 minutes, cells were harvested and stained for flow cytometry. After 4 hours, 100 µL of supernatant was collected for ELISA.

To stain for flow cytometry, cells were incubated for 15 minutes on ice with 1:20 Human TruStain FcX™ (Biolegend #422302) in PBS. CD62L-APC (Biolegend #304810) or mouse IgG1-kappa-APC isotype control (Biolegend #400222) were added to cells at a final dilution of 1:40, and cells were stained for 30 minutes before washing. Data was acquired on an Attune flow cytometer (Thermo Fisher) and analyzed using FlowJo software (TreeStar). The percent of cells that expressed CD62L was calculated as those with fluorescence greater than isotype control-stained cells. To measure cytokines, supernatants were tested on a Human IL-8 Duoset ELISA kit (R&D #DY208), according to manufacturer's instructions. The optical density was measured on a SpectraMax Machine and the concentration of cytokine was calculated using SoftMax Pro software. All data was graphed using GraphPad Prism software and shows mean±standard error.

Figure 22A:
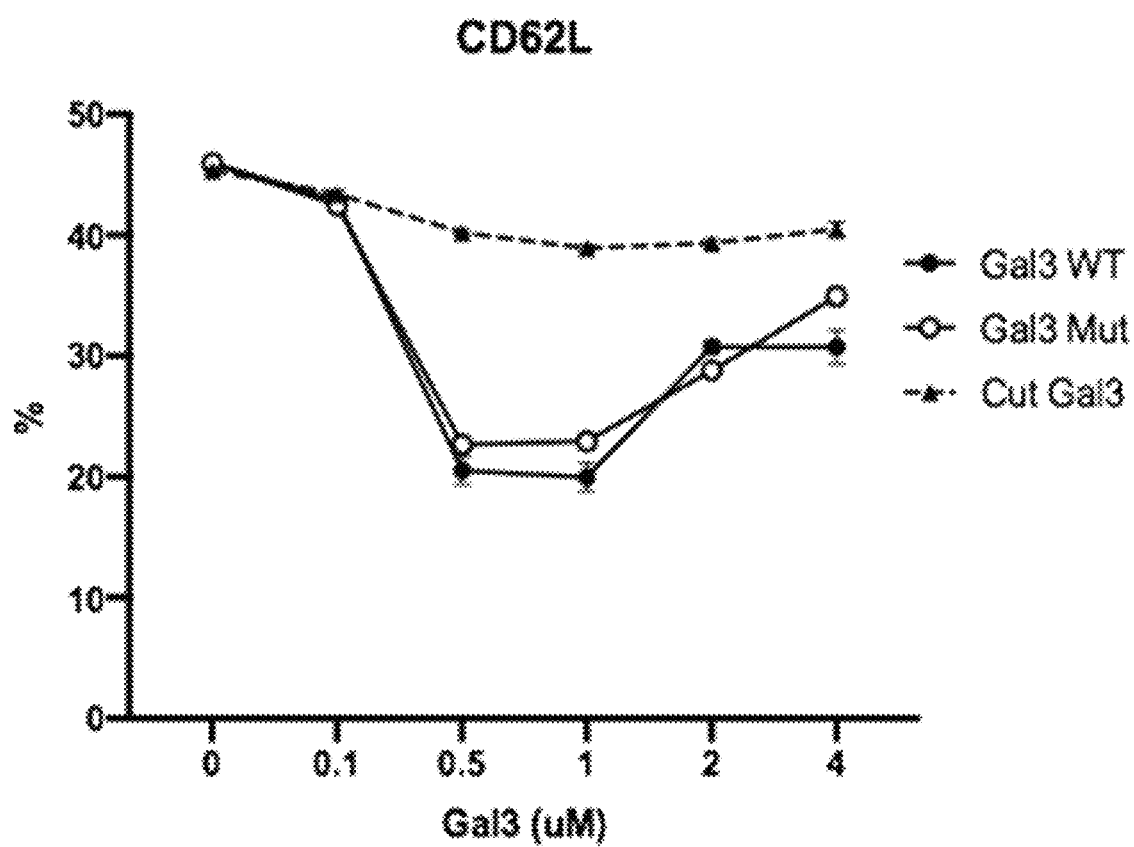
FIG. 22A-B depict the impact of Gal3 constructs (full length wild-type, truncated, and P64H mutant Gal3) on neutrophil shedding of CD62L (FIG. 22A) and secretion of IL-8 (FIG. 22B).
Figure 22B:
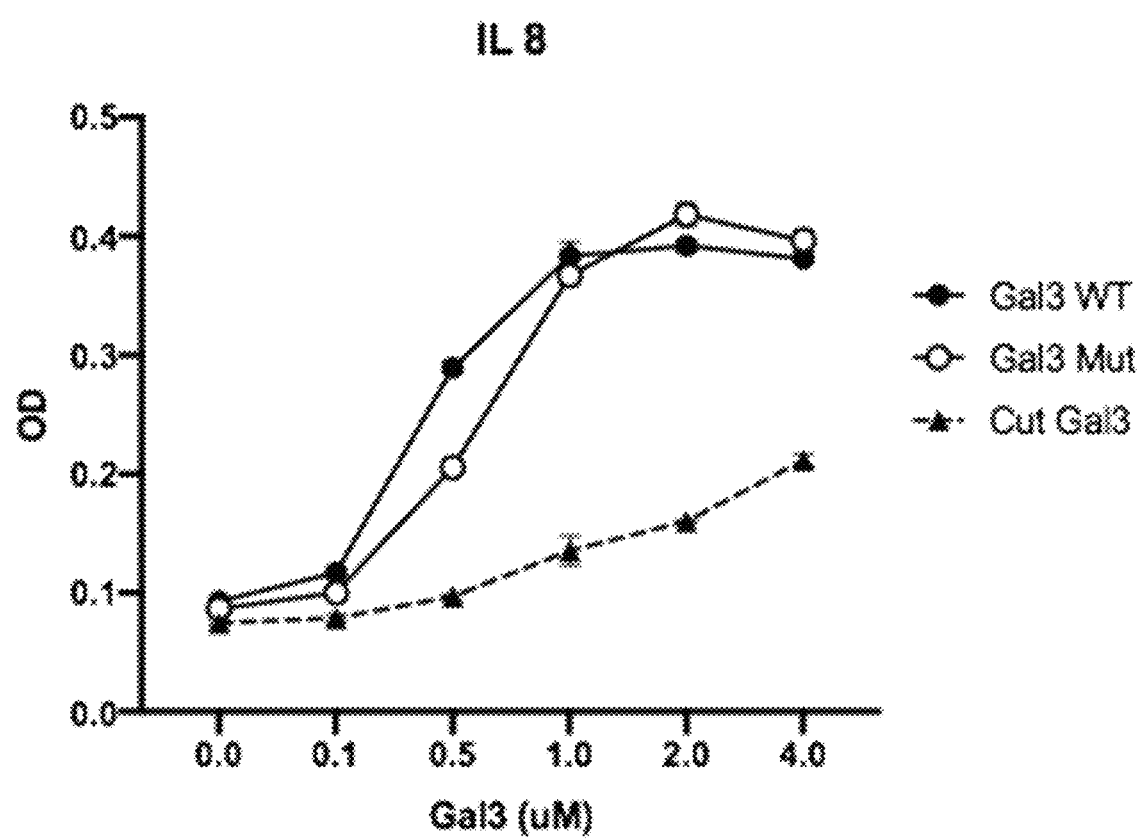

Cleavage of the extracellular domain of CD62L allows neutrophils to extravasate into tissue and migrate to the source of injury or infection. Gal3 WT and Gal3 Mut decreased the percent of cells that were positive for CD62L in a dose-dependent manner, demonstrating that Gal3 can promote neutrophil infiltration into tissue. However, Gal3 Cut did not affect CD62L, demonstrating that the amino-terminal domain of Gal3 is required for activity (FIG. 22A). IL-8 is a cytokine that is up-regulated after activation and directs migration towards a source of injury or infection. Gal3 WT and Gal3 Mut increased IL-8 in a dose-dependent manner, demonstrating that Gal3 can activate neutrophils and enhance their migration. However, Gal3 Cut was less effective, demonstrating that the amino-terminal domain of Gal3 is required for activity (FIG. 22B).

Example 12. Anti-Gal3 Antibodies Reduce Activation of Neutrophils

A neutrophil cell line was treated with Gal3 and readouts of neutrophil activation and migration were measured. HL60 promyelocytic cells (ATCC #CCL-240) were stimulated for four days with 1.3% DMSO to differentiate the cell line into neutrophils. $2 \times 10^5$ cells were then plated in serum-free media on a 96 well plate in triplicate for each condition. Recombinant human Gal3 (rhGal3) (TrueBinding #QC200361) at 1, 0.5, 0.25, 0.125, and 0.0625 or 0 µM was pre-incubated for 30 minutes with 1 µM of the anti-Gal3 antibody TB001 or media-only control, then added to the cells. Samples were collected four hours after the treatment for analysis by flow cytometry and ELISA.

To stain for flow cytometry, cells were incubated for 15 minutes on ice with a 1:80 dilution of Human TruStain FcX™ (Biolegend #422302) in PBS. CD62L-APC (Biolegend #304810) was added to cells at a final dilution of 1:40, and cells were stained for 30 minutes before washing. Data was acquired on an Attune flow cytometer (Thermo Fisher) and analyzed using FlowJo software (TreeStar). The percent of cells that expressed CD62L was calculated as those with higher fluorescence than with unstained control cells. To measure cytokines, supernatants were tested on a Human IL-8 Duoset ELISA kit (R&D #DY208), according to manufacturer's instructions. The optical density was measured on a SpectraMax machine and the concentration of cytokine was calculated using SoftMax Pro software. All data was graphed using GraphPad Prism software with technical replicate values shown for each condition.

Figure 23A:
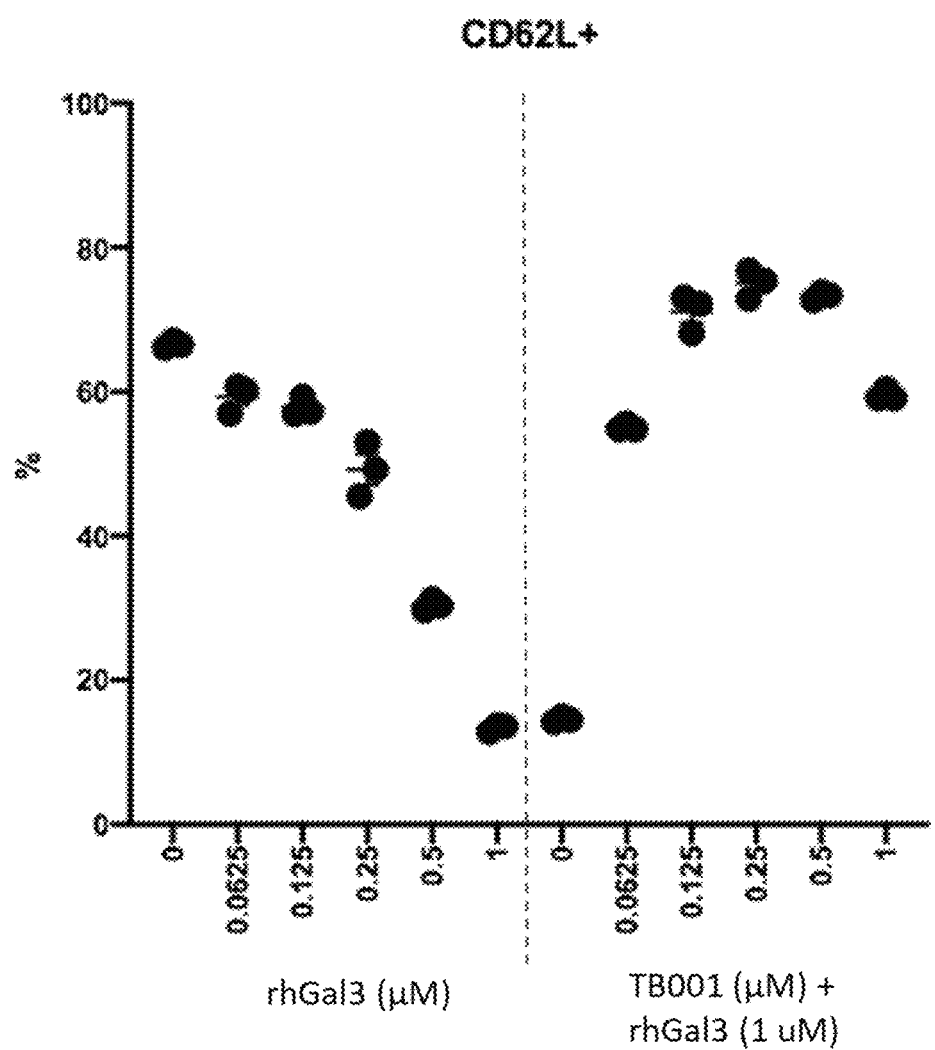
FIG. 23A-B depict the effects of the exemplary anti-Gal3 antibody TB001 on reversing Gal3-induced shedding of CD62L (FIG. 23A) and IL-8 secretion (FIG. 23B) by activated neutrophils.

Cleavage of the extracellular domain of CD62L allows neutrophils to extravasate into tissues and migrate to the source of injury or infection. rhGal3 decreased the percent of cells that were positive for CD62L in a dose-dependent manner, demonstrating that Gal3 can promote neutrophil infiltration into tissue. Treatment with TB001 reversed the loss of CD62L (FIG. 23A).

Figure 23B:
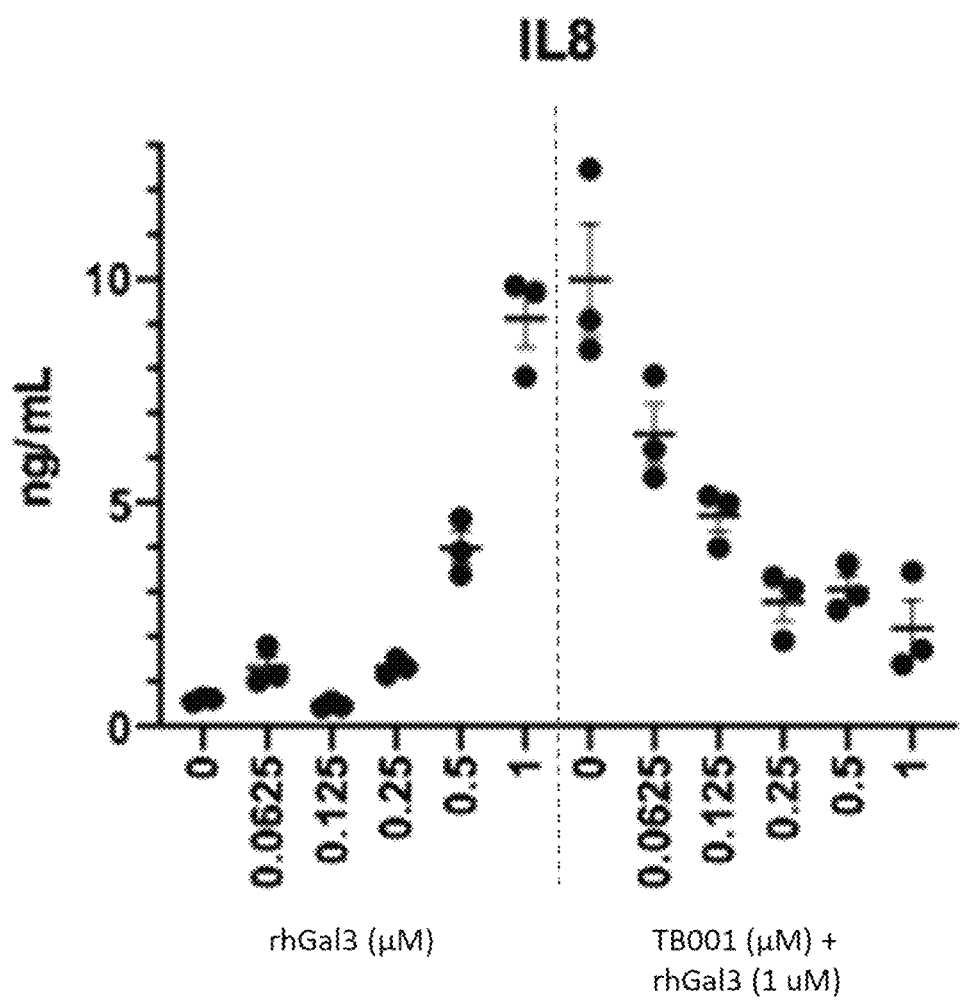

IL-8 is a cytokine that is up-regulated after activation and directs migration towards a source of injury or infection. rhGal3 increased IL-8 in a dose-dependent manner, demonstrating that Gal3 can activate neutrophils and enhance their migration. Treatment with TB001 reversed the increase of IL-8 production (FIG. 23B).

To identify additional anti-Gal3 antibodies that can suppress neutrophil function, a panel of anti-Gal3 antibodies or isotype control MOPC21 hIgG4 were tested on HL60 cells differentiated for 96 hours with 1.3% DMSO. 1 µM antibody was pre-incubated with 1 µM of rhGal3 for 30 minutes. The complexes were then added to cells for four hours before testing with CD62L and IL-8 expression.

To stain for flow cytometry, cells were incubated for 15 minutes on ice with a 1:20 dilution of Human TruStain FcX™ (Biolegend #422302) in PBS. CD62L-APC (Biolegend #304810) or Mouse IgG1, kappa-APC isotype control (Biolegend #400222) was added to cells at a final dilution of 1:40, and cells were stained for 30 minutes before washing. Data was acquired on an Attune flow cytometer (Thermo Fisher) and analyzed using FlowJo software (TreeStar). The percent of cells that expressed CD62L was calculated as those with higher fluorescence than with isotype control-stained cells and the average of technical replicates was calculated (Table 2).

To measure cytokines, supernatants were tested on a Human IL-8 Duoset ELISA kit (R&D #DY208), according to manufacturer's instructions. The optical density was measured on a SpectraMax machine and the concentration of cytokine was calculated using SoftMax Pro software. All data was graphed using GraphPad Prism software and the average of technical replicates was calculated. The level of IL-8 induced by 1 µM rhGal with or without anti-Gal3 antibodies is shown in Table 2. Antibodies that reduce CD62L cleavage by at least 75% and/or reduce CL-8 production by at least 33% are listed in Table 3.

The antibody 14D11.2D2 is an antibody specific for the C-terminal carbohydrate binding domain of Gal3 and has been previously described in PCT Publication WO 2019/152895, which is hereby expressly incorporated by reference in its entirety.

TABLE 2

Inhibition of CD62L shedding and IL-8 production by anti-Gal3 antibodies

| Antibody Name | Antibody Bin | % inhibition of CD62L shedding (relative to isotype control-stained cells) | % inhibition of IL-8 production (relative to isotype control-stained cells) |
| --- | --- | --- | --- |
| TB001 | 1 | 87.2 | 70.5 |
| 20H5.A3 | 3 | 66.3 | 18.0 |
| 23H9.2E4 | 3 | 91.9 | 2.5 |
| 2D10-VH0-VL0 | 3 | 62.4 | −1.7 |
| TB006 (4A11.H3L1) | 3 | 76.1 | 12.5 |
| 15G7.2A7 | 5 | 110.0 | 40.0 |
| 20D11.2C6 | 5 | 89.4 | 40.6 |
| 13A12.2E5 | 7 | 87.1 | 29.8 |
| 3B11.2G2 | 7 | 92.7 | 25.2 |
| 14H10.2C9 | 8 | 86.3 | −9.4 |
| 15F10.2D6 | 8 | 82.5 | 50.0 |
| 7D8.2D8 | 8 | 88.6 | 20.8 |
| 846T.14E4 (F846TC.14E4) | 8 | 90.3 | 45.7 |
| 846T.7F10 (F846TC.7F10) | 8 | 96.1 | 48.3 |
| 849.8D10 (F849C.8D10) | 8 | 180.0 | 53.4 |
| 849.2D7 | 10 | 78.1 | 52.8 |
| 24D12.2H9 | 11 | 73.1 | 0.8 |
| 6B3.2D3 | 11 | 98.9 | 15.6 |
| 849.1D2 | 11 | 130.0 | 69.1 |
| 13G4.2F8 | 12 | 94.3 | 43.8 |
| 9H2.2H10 | 12 | 67.7 | 30.7 |
| 846.1B2 (F846C.1B2) | 17 | 99.0 | 33.2 |
| 846.1F5 (F846C.1F5) | 17 | 76.3 | 50.1 |
| 846.1H12 (F846C.1H12) | 17 | 100.0 | 53.7 |
| 846.2H3 (F846C.2H3) | 17 | 93.6 | 56.1 |
| 846T.16B5 (F846TC.16B5) | 17 | 84.2 | 43.6 |
| 849.5H1 | 21 | 87.5 | 46.5 |
| 847.12C4 | B2C10 | 150.0 | 37.3 |
| 847.15D12 | B2C10 | 15.4 | −45.7 |
| 847.15H11 | B2C10 | 39.3 | 62.5 |
| 847.20H7 | B2C10 | 63.4 | −15.0 |
| 847.27B9 | B2C10 | 87.9 | 15.8 |
| 847.10C9 | CRD | 150.0 | 46.4 |
| 847.11D6 | CRD | 83.2 | 26.3 |
| 847.13E2-mH0mL1 | CRD | 79.9 | 7.4 |
| 847.13E2-mH0mL2 | CRD | 18.8 | −25.8 |
| 847.16D10 | CRD | 14.4 | −101.3 |
| 847.23F11 | CRD | 15.2 | −11.6 |
| 847.28D1 | CRD | 110.0 | 63.0 |
| 847.3B3 | CRD | 43.4 | 23.9 |
| 847.10B9 (F847C.10B9) | Unassigned | 82.2 | 35.2 |
| 847.11B1 (F847C.11B1) | Unassigned | 29.2 | 30.0 |
| 847.4B10 (F847C.4B10) | Unassigned | 110.0 | 38.7 |
| 849.8D12 | Unassigned | 74.4 | 12.4 |
| 846.2B11 | No binding | 8.2 | −20.0 |
| 846T.4C9 | No binding | 11.2 | −66.7 |
| 847.15F9 | No binding | 8.5 | −48.3 |
| 847.21B11 | No binding | 16.4 | −31.8 |
| 847.2B8 | No binding | 7.0 | −43.0 |
| 847.4D3 | No binding | 7.5 | −34.8 |
| 849.4F12 | No binding | 17.9 | −48.3 |
| 849.4B2 | No binding | 6.2 | −42.6 |
| 846.1H5 (F846C.1H5) | Unassigned | 100.0 | 38.6 |

TABLE 2-continued

Inhibition of CD62L shedding and IL-8 production by anti-Gal3 antibodies

| Antibody Name | Antibody Bin | % inhibition of CD62L shedding (relative to isotype control-stained cells) | % inhibition of IL-8 production (relative to isotype control-stained cells) |
|---|---|---|---|
| 14D11.2D2 | Unassigned | 86.2 | 35.0 |
| 847.14H4 | Unassigned | 34.4 | −38.8 |
| 847.26F5 (F847C.26F5) | Unassigned | 69.7 | 32.6 |
| 849.2F12 | Unassigned | 120.0 | 58.3 |
| MOPC21 (mouse isotype) | Unassigned | 21.1 | −18.7 |

TABLE 3

Exemplary anti-Gal3 antibodies with significant effect on CD62L shedding and IL-8 production

| Antibody Name | % inhibition of CD62L shedding (relative to isotype control-stained cells) | % inhibition of IL-8 shedding (relative to isotype control-stained cells) |
|---|---|---|
| 846.1H5 | 100.0 | 38.6 |
| 847.4B10 | 110.0 | 38.7 |
| 847.10B9 | 82.2 | 35.2 |
| 847.28D1 | 110.0 | 63.0 |
| 847.10C9 | 150.0 | 46.4 |
| 847.12C4 | 150.0 | 37.3 |
| 849.5H1 | 87.5 | 46.5 |
| 846.2H3 | 93.6 | 56.1 |
| 846.1H12 | 100.0 | 53.7 |
| 846.1F5 | 76.3 | 50.1 |
| 846T.16B5 | 84.2 | 43.6 |
| 846.1B2 | 99.0 | 33.2 |
| 13G4.2F8 | 94.3 | 43.8 |
| 849.1D2 | 130.0 | 69.1 |
| 849.2D7 | 78.1 | 52.8 |
| 849.8D10 | 180.0 | 53.4 |
| 15F10.2D6 | 82.5 | 50.0 |
| 846T.7F10 | 96.1 | 48.3 |
| 846T.14E4 | 90.3 | 45.7 |
| 20D11.2C6 | 89.4 | 40.6 |
| 15G7.2A7 | 110.0 | 40.0 |
| TB001 | 87.2 | 70.5 |
| 849.2F12 | 120.0 | 58.3 |
| 14D11.2D2 | 86.2 | 35.0 |

Example 13. Anti-Gal3 Antibodies Reduce Inflammation in a Model of Inflammatory Lung Disease The ability of anti-Gal3 antibodies to reduce lung inflammation in vivo was tested in a mouse model of chronic obstructive pulmonary disease (COPD). The animal experiment was performed in accordance with standard guidelines and regulations, and the protocol was approved by the Institutional Animal Care and Use Committee (IACUC) at TrueBinding. Elastase is a proteolytic enzyme that is released by activated neutrophils in the lungs and leads to breakdown of alveolar tissue, inflammation and emphysema. Five units of porcine pancreatic elastase (Elastin Products Company #EC134) was distilled intratracheally into C57BL/6 mice (Jackson Laboratory). Groups received either 0.4 mg/kg of mTB001, 2D10.2B2 anti-Gal3 antibody or MOPC21-mIgG2b-LALA isotype control (MOPC21) (n=9) intratracheally. Antibodies were administered intratracheally on days 0, 3, 7, 10, 14, 17, and 20 of the study. Mice (n=5) that did not receive elastase or antibodies served as healthy controls. Body weight was measured twice weekly to monitor health. On day 21 of the study, the broncheoalveolar fluid (BALF), plasma, and lung tissue was collected for analysis.

Blood samples were collected via cardiac puncture. Plasma samples were isolated by spinning down at 4° C. using 13,000 rpm for 10 minutes. BALF samples were collected by perfusing lungs with 0.7 mL PBS.

To measure Gal3 levels, ELISA was performed on plasma and BALF of healthy controls and MOPC21 treated animals using a Mouse Galectin-3 Duoset ELISA kit (R&D Systems #DY1197), according to manufacturer's instructions.

The levels of transcripts involved in inflammation and fibrosis were quantified using qPCR. mRNA was isolated using the RNeasy Plus Mini Kit (Qiagen, #74134) according to manufacturer's instructions. The isolated mRNA was reverse transcribed to cDNA using iScript™ Reverse Transcription Supermix (BioRad #1708841) with a CFX96 Touch Real-Time PCR Detection System thermocycler (BioRad) according to manufacturer's instructions. qRT-PCR was performed using SsoAdvanced™ Universal SYBR® Green Supermix (BioRad #1725174). The forward primer and reference primers were purchased from GenScript and sequences are displayed in Table 4. Expression levels were expressed relative to the internal control GAPDH according to the comparative threshold cycle (Ct) method. Results were expressed as mean expression±SEM. Unpaired t-tests were used to determine statistical significance.

The identity and cell number of leukocyte subsets in the BALF were quantified using flow cytometry. Cells were spun down from BALF, then incubated for 15 minutes with 1:100 TruStain FcX (Biolegend #101320), 1:100 CD25-BV605 (Biolegend #102036), 1:200 CD5-FITC (Biolegend #100406), 1:200 CD11b-BV510 (Biolegend #101263), 1:100 TCRb-PerCP-CY5.5 (Biolegend #109228), 1:200 F4/80-BV780 (Biolegend #123147), 1:200 CD11c-BV650 (Biolegend #117339), 1:200 Ly6G-APC (Biolegend #127614), and 1:1000 MHCII-APC-CY7 (Biolegend 107628). After 30 minutes, the cells were washed and resuspended in PBS+DAPI (Thermo Fisher #VC2962251). Cells were analyzed on an Attune flow cytometer (Thermo Fisher) and analyzed with FlowJo software (TreeStar). Neutrophils were defined as DAPI-TCRb-F4/80-CD45+CD11b+Ly6G+ cells. Data was plotted with GraphPad Prism and one-way ANOVA was used to determine statistical significance.

The levels of myeloperoxidase (MPO) and keratinocyte-derived chemokine (KC), two mediators associated with neutrophil number and function, were quantified by ELISA. Mouse myeloperoxidase (MPO) Duoset kit (R&D Systems #DY3667) and Mouse KC Duoset kit (R&D Systems #DY453) were used according to manufacturer's instructions for the respective kits. Graphs display mean±SEM of animals in each group. Unpaired t-tests were used to determine statistical significance. KC is the murine analogue for CXCL1/growth-regulated oncogene α (GROα) and IL-8 in humans.

Figure 24A:
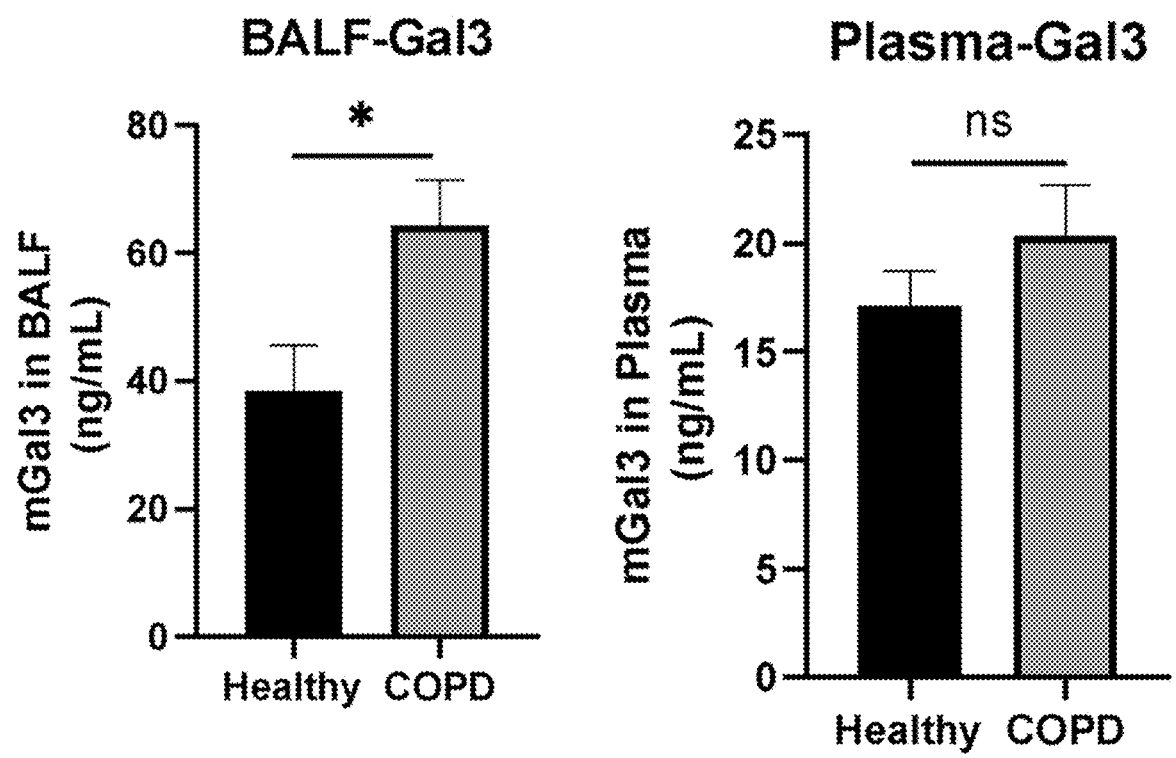
FIG. 24A-D depict the reduction of inflammation in a mouse model of inflammatory lung disease by anti-Gal3 antibodies.
Figure 24B:
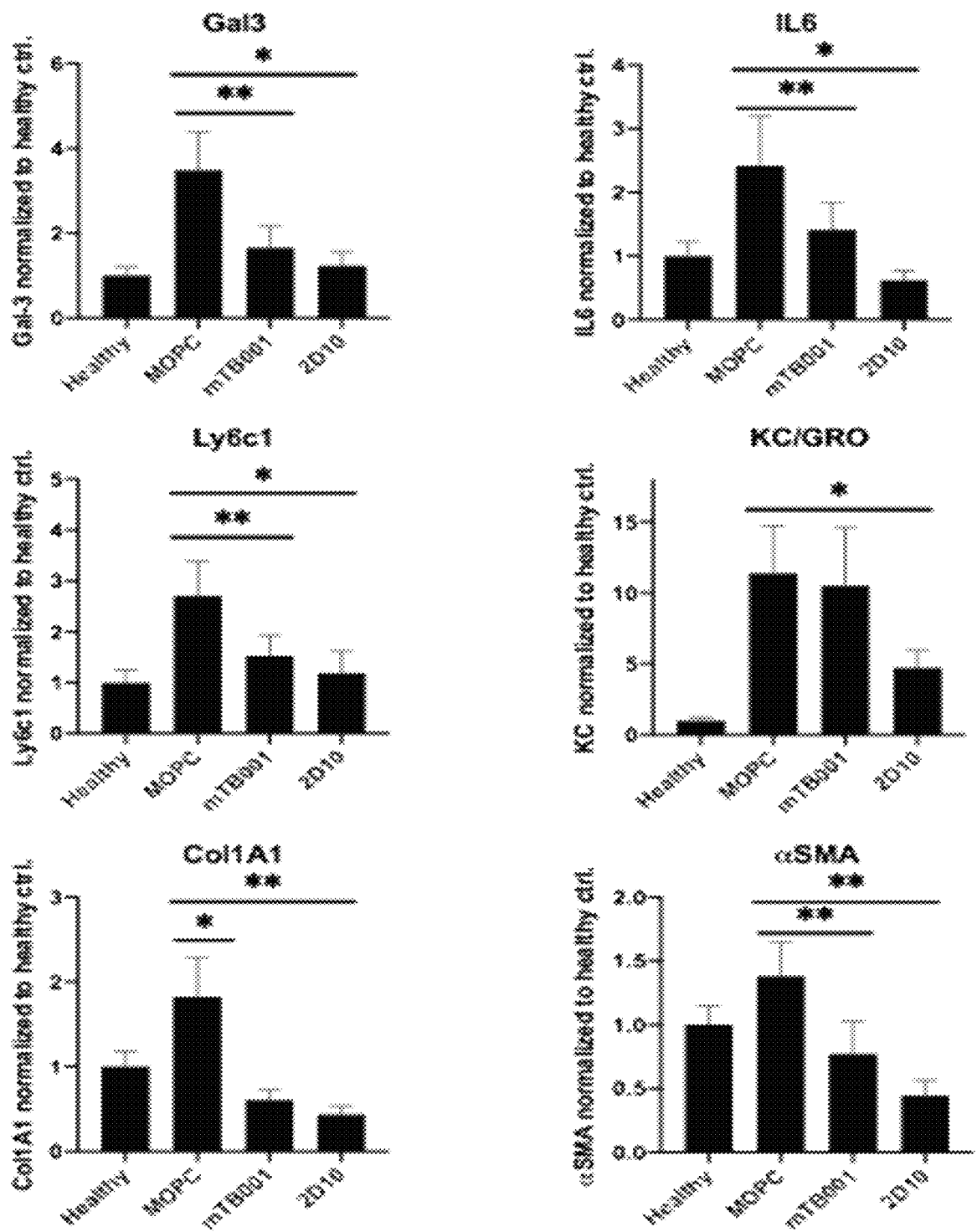
Figure 24B:
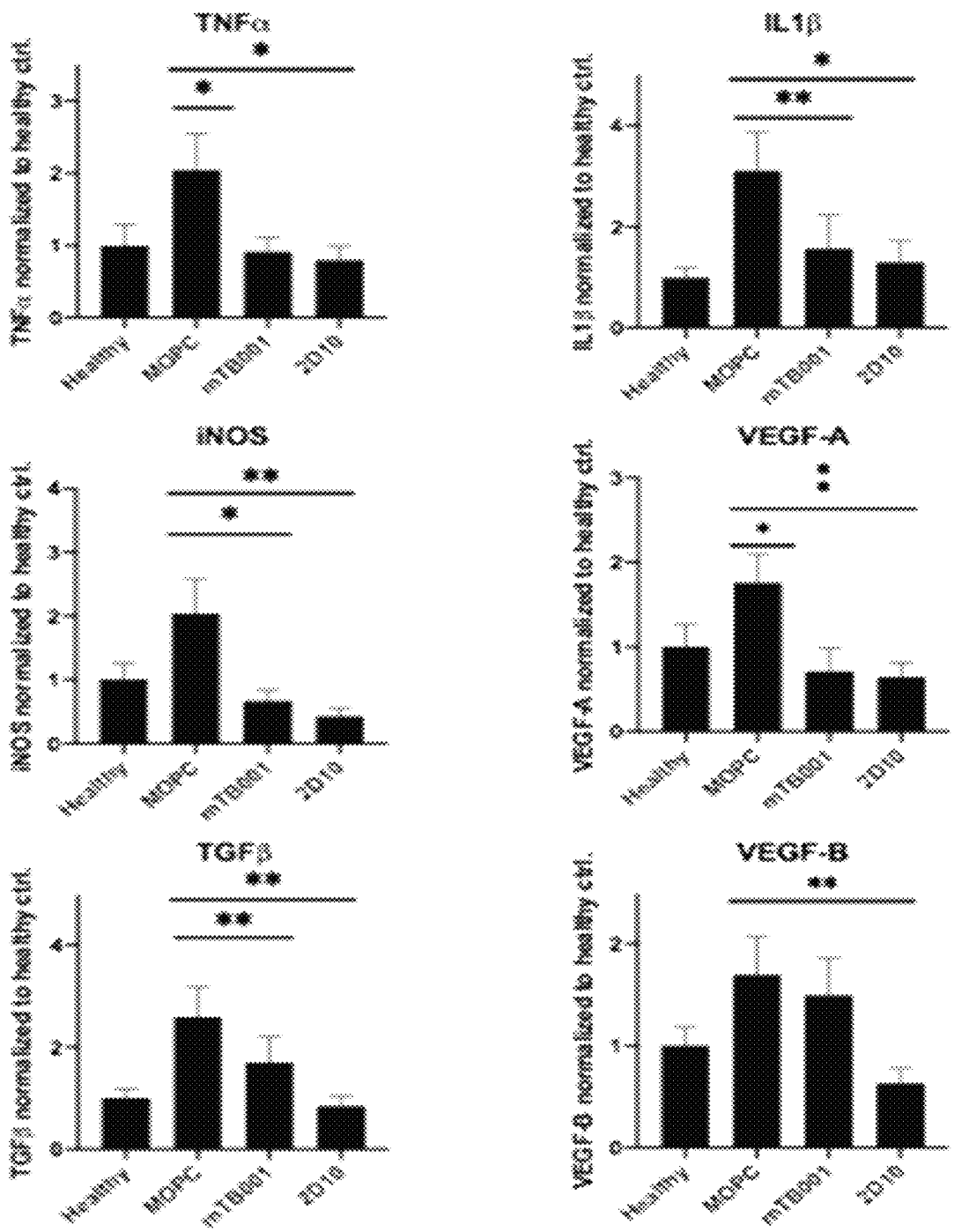

As depicted in FIG. 24A, expression of Gal3 protein is elevated in lungs but not the plasma of elastase-treated animals compared to healthy controls. Transcript levels of Gal3 were also elevated, as depicted in FIG. 24B. Hence, the target of the tested antibodies is up-regulated specifically where therapeutic action is required.

As depicted in FIG. 24B, transcripts associated with inflammation and fibrosis were increased in the lungs of MOPC21-treated animals compared to healthy controls. 2D10.2B2 (2D10) significantly reduced transcripts associated with neutrophil number and function (Ly6c1, Kc, Inos), inflammatory cytokines (Il6, Tnfa, Il1b), and fibrosis (Col1A1, aSma, Tgfb, Vegfa, Vegfb). mTB001 reduced a smaller subset of transcripts, including Tnfa, Inos, Vegfa, and Col1a1. Hence, Gal3 antibodies are able to reduce inflammation and fibrosis in lungs.

Figure 24C:
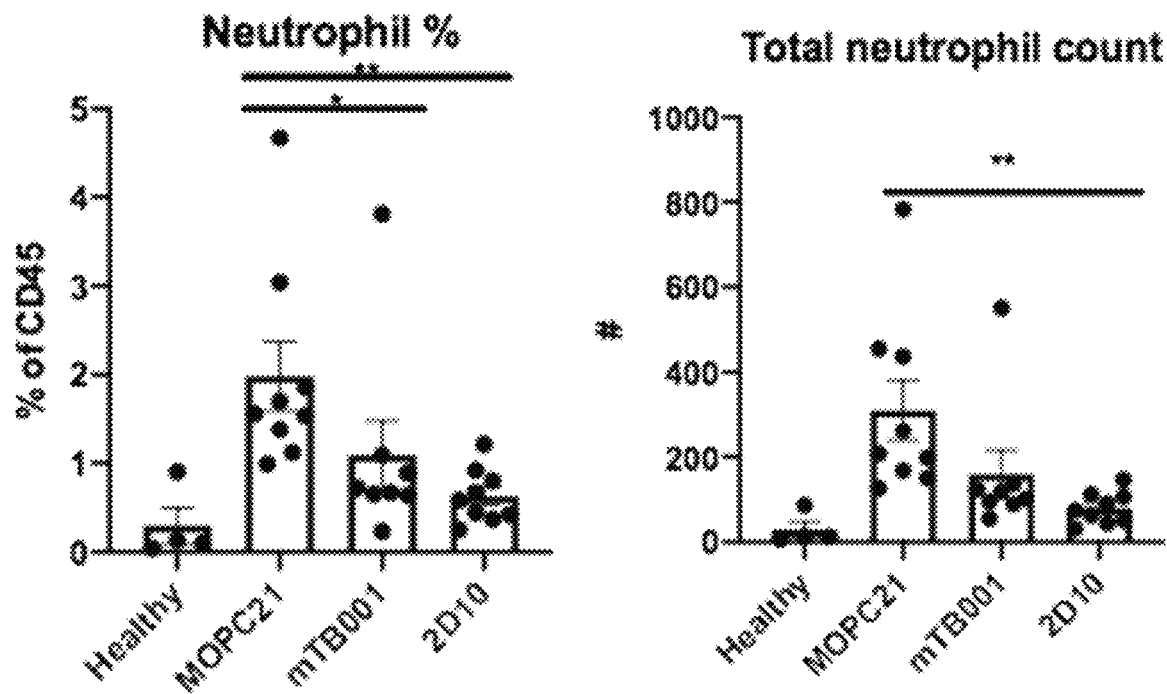

Neutrophils are a major source of lung inflammation. As depicted in FIG. 24C, the percentage and absolute numbers of neutrophils were increased in the lungs of MOPC21-treated animals compared to healthy controls, consistent with induction of inflammatory disease. Treatment with 2D10.2B2 significantly reduced the percentage and number of neutrophils compared to MOPC21 controls. There was also a trend towards reduction in mTB001 treated animals. Hence, anti-Gal3 antibodies can suppress a cellular mediator of fibrosis.

Figure 24D:
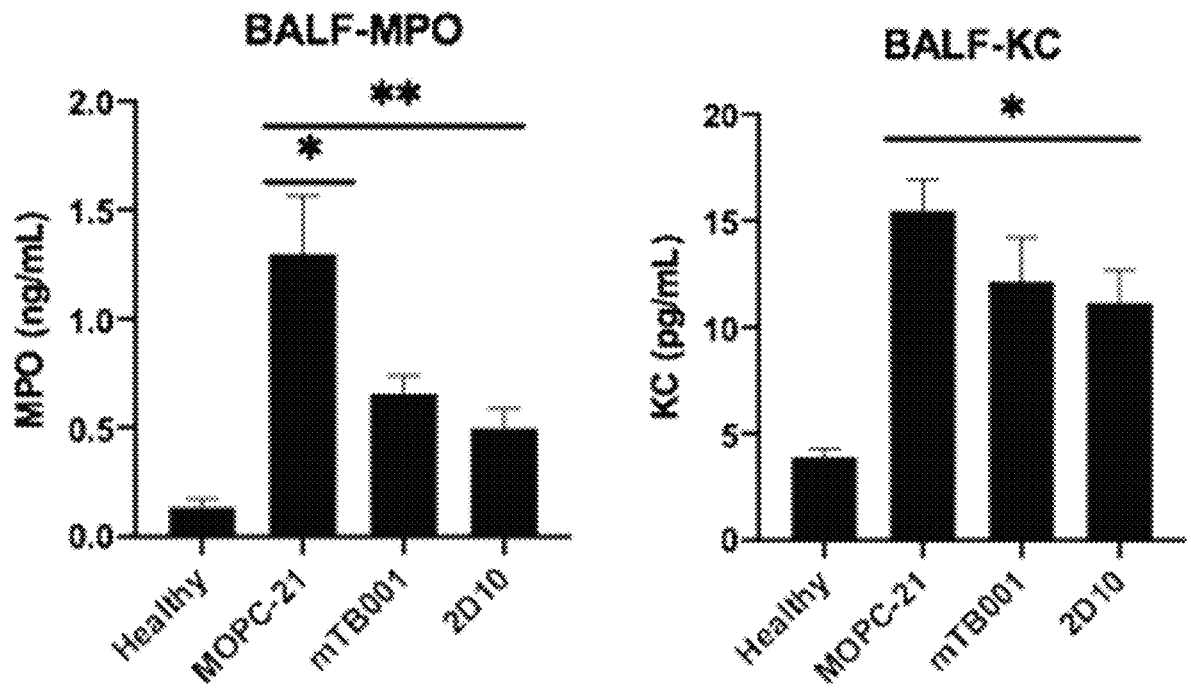

As depicted in FIG. 24D, MPO and KC were increased in the lungs of MOPC21-treated animals compared to healthy controls, consistent with activation of neutrophils in inflammatory disease. mTB001 and 2D10.2B2 significantly reduced MPO. 2D10.2B2 also significantly reduced KC. Hence, these tested anti-Gal3 antibodies can reduce biomarkers of neutrophil activity.

against components of its own host. These are deposited as immune complexes around the body, interfering with normal functioning of tissues such as the kidney. Anti-DNA antibodies are amongst the most prevalent class of autoantibody in SLE.

An anti-Gal3 antibody was tested for its ability to block or attenuate the development of SLE in a mouse model. Spleens were removed from 10-12 week old DBA/2J mice (Jackson Laboratories #000671) and mashed through a 40 µM cell strainer into PBS to generate a single cell suspension. $6 \times 10^6$ spleen cells in 200 µL PBS were injected i.v. into B6D2F1/J (Jackson Laboratories #100006) host mice to induce anti-DNA autoantibody production. Group 1 (n=7 host mice) were injected i.p. with 1 mg/kg mTB001 (TrueBinding, #QC200133) and Group 2 (n=6 host mice) were injected with PBS control twice weekly for nine weeks, starting the day before DBA/2J cells were injected. Group 3 (n=5 animals) received PBS instead of DBA/2J cells and were used as healthy controls.

After nine weeks, plasma was tested for the development of anti-single-stranded (ss) or double-stranded (ds) DNA autoantibodies using ELISA. ds-DNA (Thermo Fisher #15633-019) was boiled at 95° C. for 15 minutes to dissociate it into ss-DNA. 10 µg/mL of either ss-DNA or ds-DNA was plated overnight on ELISA plates. After washing three times in PBS+0.05% Tween-20 (PBST; Wash buffer), plates were coated for one hour in PBS+1% bovine serum albumin

TABLE 4

Primers used for measuring transcript levels of genes associated with inflammation and fibrosis

| Transcript | Forward Primers | Reverse Primers |
|---|---|---|
| Il6 | TTCCATCCAGTTGCCTTCTT (SEQ ID NO: 797) | CAGAATTGCCATTGCACAAC (SEQ ID NO: 798) |
| Tnfa | AAGAGGCACTCCCCCAAAAG (SEQ ID NO: 799) | GTTTGCTACGACGTGGGCT (SEQ ID NO: 800) |
| Il1b | GCAGTGGTTCGAGGCCTAAT (SEQ ID NO: 801) | TGATACTGCCTGCCTGAAGC (SEQ ID NO: 802) |
| Col1a1 | CCTCAGGGTATTGCTGGACAAC (SEQ ID NO: 803) | CAGAAGGACCTTGTTTGCCAGG (SEQ ID NO: 804) |
| aSma | TGAACAAGCCGGTGCTCTC (SEQ ID NO: 805) | GGTCAGGATACCTCGCTTGC (SEQ ID NO: 806) |
| Tgfb | ATGCTAAAGAGGTCACCCGC (SEQ ID NO: 807) | TGCCGTACAACTCCAGTGAC (SEQ ID NO: 808) |
| Vegfa | CTGCTGTAACGATGAAGCCCTG (SEQ ID NO: 809) | GCTGTAGGAAGCTCATCTCTCC (SEQ ID NO: 810) |
| Vegfb | ACTGGGCAACACCAAGTCCAA (SEQ ID NO: 811) | CACATTGGCTGTGTTCTTCCAGG (SEQ ID NO: 812) |
| Inos | AAGGCAAGCACCTTGGAAGA (SEQ ID NO: 813) | GGACAGCTTCTGGTCGATGT (SEQ ID NO: 814) |
| Gal3 | GCCCTTGCCTGGAGGAGTCATG (SEQ ID NO: 815) | CATTGAAGCGGGGGTTAAAGTGG (SEQ ID NO: 816) |
| Gapdh | CATCACTGCCACCCAGAAGACTG (SEQ ID NO: 817) | ATGCCAGTGAGCTTCCCGTTCAG (SEQ ID NO: 818) |

Example 14. Anti-Gal3 Antibodies Attenuate Systemic Lupus Erythematosus (SLE)

Systemic lupus erythematosus (SLE) is an autoimmune disease wherein the immune system makes antibodies (BSA) (EMD Millipore Corp #126609-100GM). Plates were washed, then standards and samples were added to the plate. Standards were generated by making 15 two-fold dilutions of a mouse anti-DNA antibody (Abcam #ab27156) ranging from 1 µg/mL to 0.6 µg/mL. Samples were diluted 1:40, 1:400, and 1:4000 before adding to plates. After two hours, plates were washed and 1:10,000 goat anti-mouse-biotin antibody (Thermo Fisher #62-6540) was added to the plates for one hour. After washing, 1:10,000 streptavidin-HRP (Thermo Fisher #N100) was added for 30 minutes. After washing, TMB (Thermo Scientific #34029) was added for one minute before the reaction was stopped with 1N HCl. OD450 was read on a SpectraMax plate reader and data was analyzed using SoftMax Pro software. One-way ANOVA was used to determine statistical significance.

Figure 25:
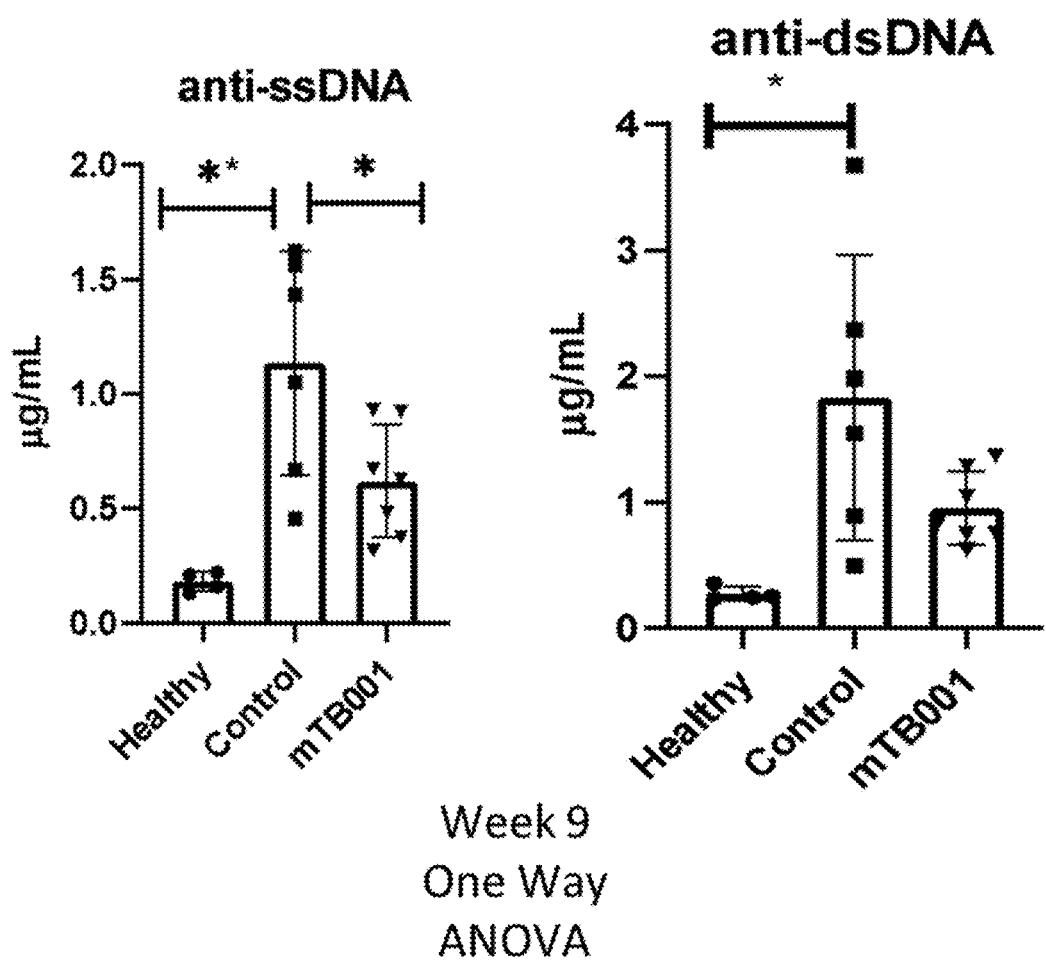
FIG. 25 depicts a reduction in anti-DNA autoantibody generation by treatment of the exemplary anti-Gal3 antibody mbTB001 in a graft versus host disease mouse model.

FIG. 25 demonstrates that hosts injected with DBA/2J cells developed anti-ss-DNA autoantibodies while no autoantibodies were detected in healthy controls. mTB001 significantly decreased levels of anti-ss-DNA autoantibodies by two-fold on average. DBA/2J cells induced development of anti-ds-DNA autoantibodies compared to healthy controls. mTB001 decreases levels of auto-ds-DNA autoantibodies.

Example 15. Binning of Anti-Gal3 Antibodies

Table 2 also depicts epitope binning of the tested exemplary anti-Gal3 antibodies.

The epitope binning assay was done in a sandwich format on the high-throughput SPR-based Carterra LSA unit (CarterraBio, Salt Lake City, UT). First, the purified antibodies were diluted to 10 µg/ml concentration in 10 mM NaOAc (pH 5.0) and then were covalently coupled via amine group to HC200M chip activated by EDC and S-NHS to immobilize antibodies to different positions of a 384-spot array. One hundred thirty-eight binning cycles were run on the array of immobilized antibodies. In each cycle, first, human Gal3 (AcroBio GA3-H5129) was injected over the entire array to bind to different antibodies (primary antibody), followed by one antibody (secondary antibody) selected among the panel of anti-GAL3 antibodies tested. At the end of each cycle, the array was regenerated by 10 mM Glycine (pH 2.0) to remove bound antigen and secondary antibody from the array. The data analysis was done using the Epitope software by CarterraBio.

Binning results are shown in Table 2. In total, 21 distinct bins were identified for anti-GAL3 antibodies that demonstrate binding to hGAL3 (8 tested antibodies did not bind hGAL3 when immobilized on the HC200M under the tested conditions).

Antibody TB001 defined bin 1. Antibodies 20H5.A3, 23H9.2E4, 2D10-VH0-VL0 and TB006 (4A11.H3L1) exhibited mutual competitive binding for hGAL3, but did not prevent binding of the rest of the clones, thus defining bin 3. Antibodies 15G7.2A7 and 20D11.2C6 exhibited mutual competitive binding for hGAL3, but did not prevent binding of the rest of the clones, thus defining bin 5. Antibodies 13A12.2E5 and 3B11.2G2 exhibited mutual competitive binding for hGAL3, but did not prevent binding of the rest of the clones, thus defining bin 7. Antibodies 14H10.2C9, 15F10.2D6, 7D8.2D8, 846T.14E4, 846T.7F10, and 849.8D10 exhibited mutual competitive binding for hGAL3, but did not prevent binding of the rest of the clones, thus defining bin 8. Antibody 849.2D7 defined bin 10. Antibodies 24D12.2H9, 6B3.2D3, 849.1D2 exhibited mutual competitive binding for hGAL3, but did not prevent binding of the rest of the clones, thus defining bin 11. Antibodies 13G4.2F8 and 9H2.2H10 exhibited mutual competitive binding for hGAL3, but did not prevent binding of the rest of the clones, thus defining bin 12. Antibodies 846.1B2, 846.1F5, 846.1H12, 846.2H3, and 846T.16B5 exhibited mutual competitive binding for hGAL3, but did not prevent binding of the rest of the clones, thus defining bin 17. Antibody 849.5H1 defined bin 21.

Antibodies 847.12C4, 847.15D12, 847.15H11, 847.20H7, and 847.27B9 exhibited mutual competitive binding and competed with binding with the commercially available anti-Gal3 antibody B2C10 for hGAL3, but did not prevent binding of the rest of the clones, thus defining bin "B2C10". B2C10 has been epitope mapped to bind to the first 18 amino acids of Gal3. Antibodies 847.10C9, 847.11D6, 847.13E2-mH0mL1, 847.13E2-mH0mL2, 847.16D10, 847.23F11, 847.28D1, and 847.3B3 exhibited mutual competitive binding to the C-terminal carbohydrate-recognition domain (CRD), but did not prevent binding of the rest of the clones, thus defining bin "CRD". Antibodies 847.10B9, 847.11B1, 847.4B10, 846.1H5, 847.14H4, 847.26F5, 849.2F12, 14D11.2D2, and MOPC21 were either not tested or not assigned to a bin. Antibodies 846.2B11, 846T.4C9, 847.15F9, 847.21B11, 847.2B8, 847.4D3, 849.4F12, and 849.4B2 were determined to not bind to hGAL3 under the conditions tested.

Example 16. Anti-Gal3 Antibodies Reduces Cytokine Production by Neutrophils Under Pro-Inflammatory Conditions Cytokines, such as TNFα and IL-6, released by neutrophils in response to pro-inflammatory conditions (e.g. infection or autoimmunity) can initiate and perpetuate disease symptoms in patients. The involvement of Gal3 in regulating cytokine secretion and the ability of anti-Gal3 antibody to alter any effects were tested. HL60 promyelocytic cells (ATCC, #CCL-240) were stimulated for four days with 1.3% DMSO to differentiate the cell line into neutrophils. $2 \times 10^5$ cells were treated with a mixture of recombinant Gal3 and the pro-inflammatory stimulus lipopolysaccharide (LPS) with or without anti-Gal3 antibodies. The mixture was pre-incubated together before being added to cells. Conditions were assayed in duplicate or triplicate.

To prepare the mixture without antibodies, different concentrations of recombinant human Gal3 (rhGal3) (TrueBinding, #QC200361) ranging from 0.015625 µM to 1 µM were pre-incubated with media. To prepare the mixture with antibodies, 1 µM recombinant human Gal3 was pre-incubated with the anti-Gal3 antibodies TB001 or TB006 or MOPC21-hIgG4(S228P) isotype control at concentrations ranging from 0.0625 µM to 4 P M. For both mixtures, 0.1 ng/mL LPS (Sigma-Aldrich, #L2880) was added after 30 minutes. After the additional 30 minute incubation, the whole mixture was added to the differentiated HL60 cells. All treatments used serum-free media and are expressed as the final concentration when all components were added.

Figure 26:
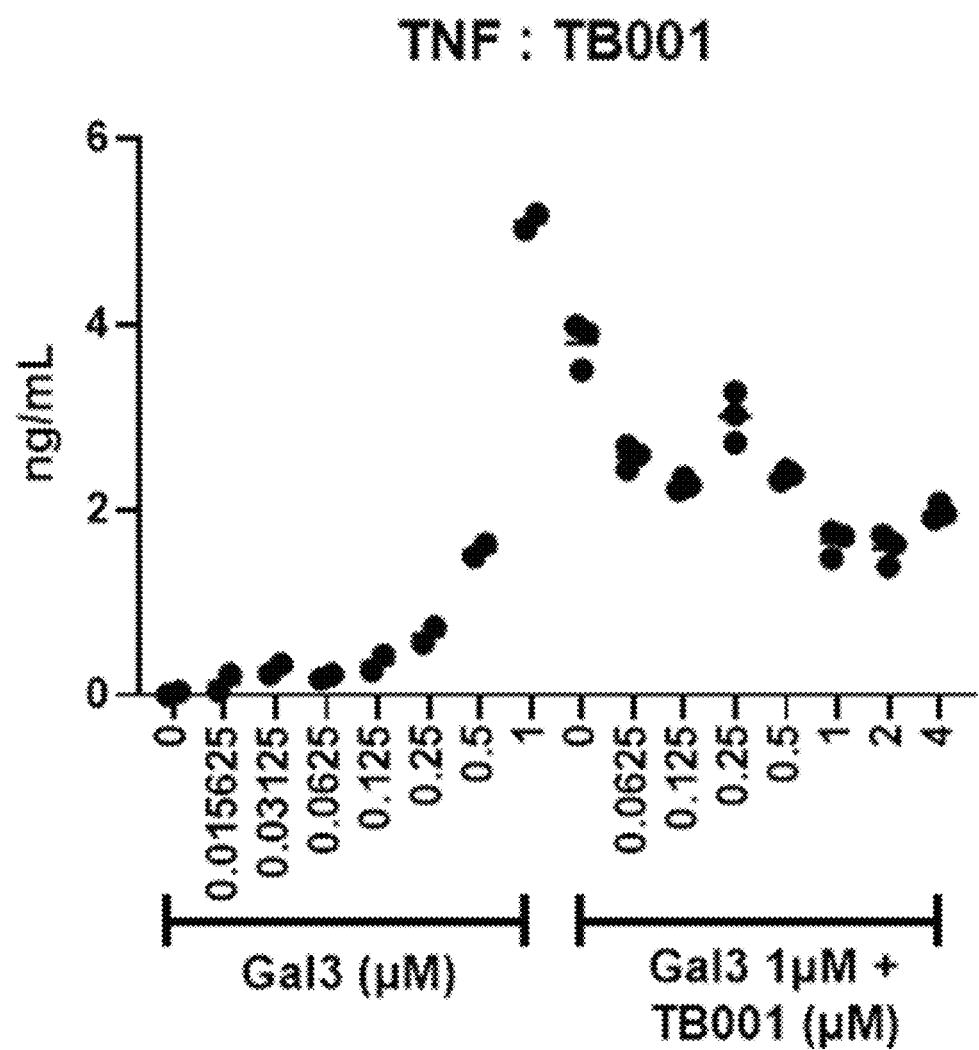
FIG. 26 depicts reduction of TNFα production by activated neutrophils under pro-inflammatory conditions by treatment with the exemplary anti-Gal3 antibodies TB001 and TB006 compared to the control antibody MOPC21.
Figure 26:
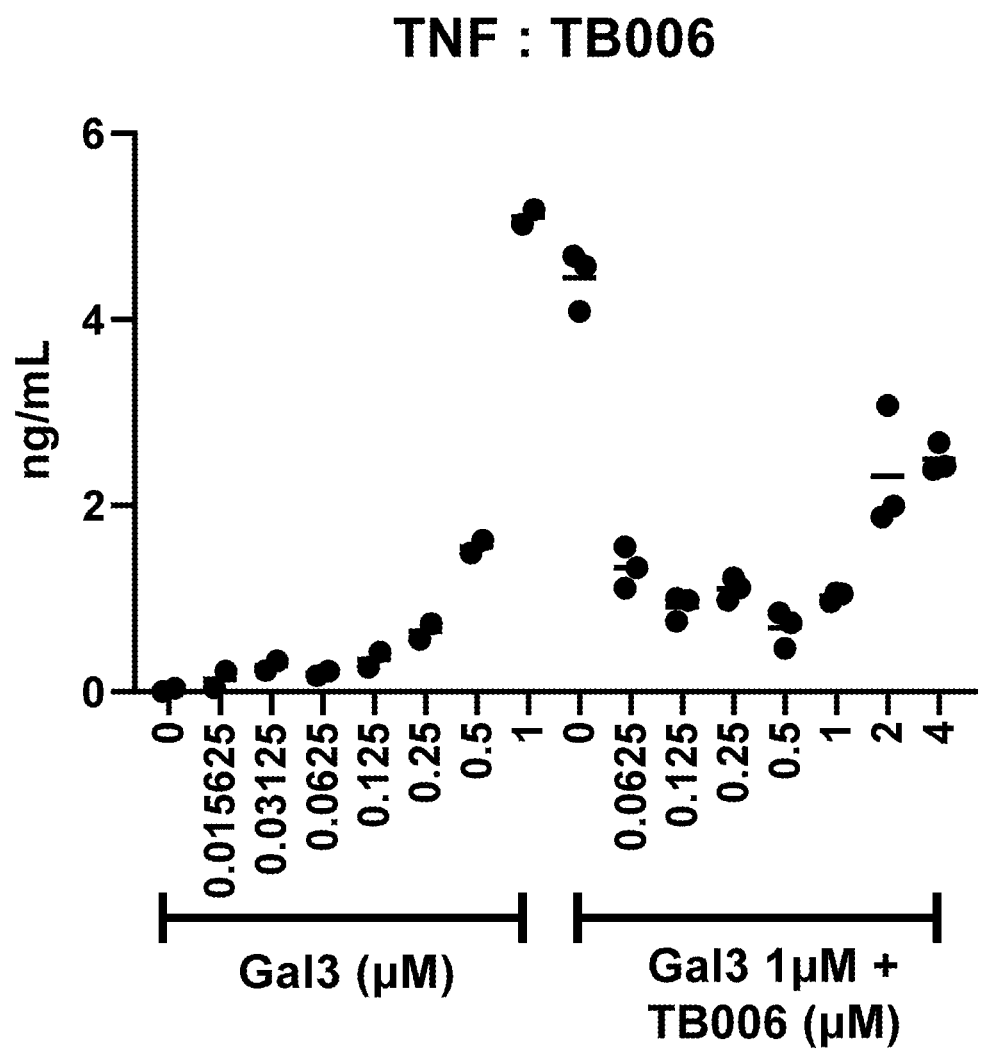
Figure 26:
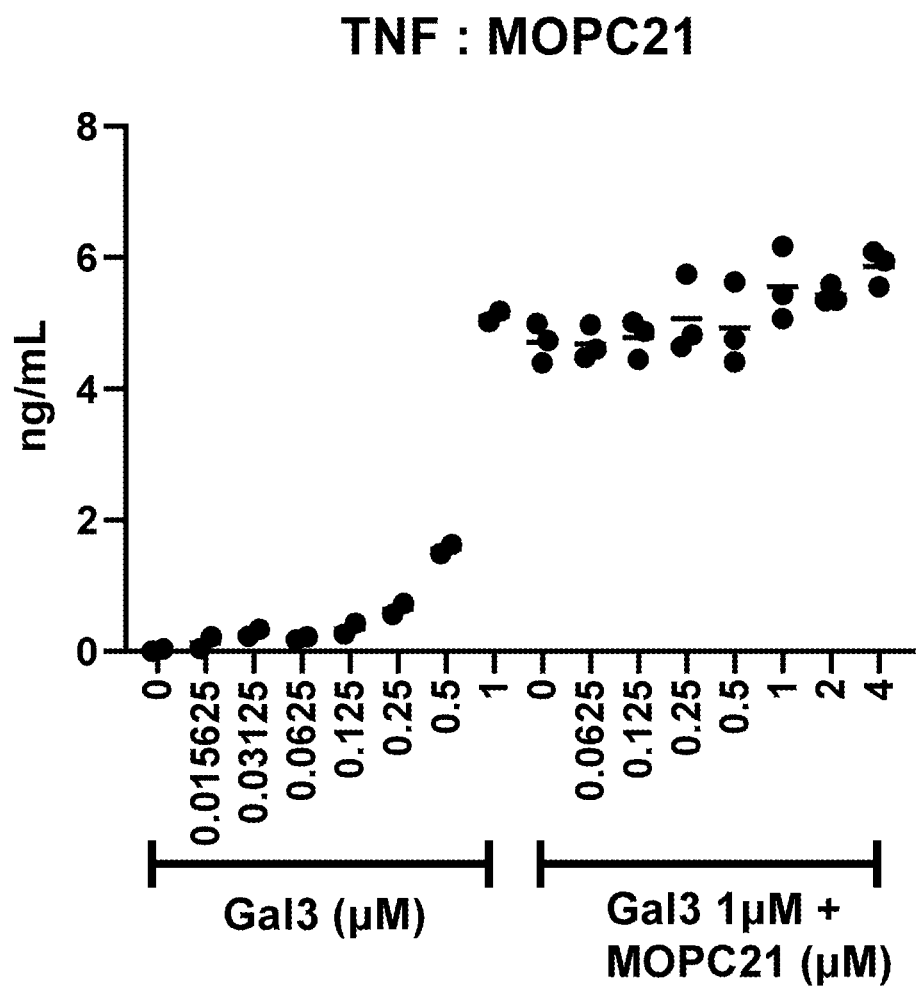

Supernatants were collected four hours after treatment for cytokine measurement and tested for cytokines using a TNFα ELISA kit (R&D, #DY288) and an IL-6 ELISA kit (Thermo Fisher, #88-7066-88), according to manufacturer's instructions. ELISA plates were read with a SpectraMax spectrophotometer and data analyzed with GraphPad Prism. Each dot in the graph represents a technical replicate. FIG. 26 displays data for TNFα and FIG. 27 displays data for IL-6.

Figure 27:
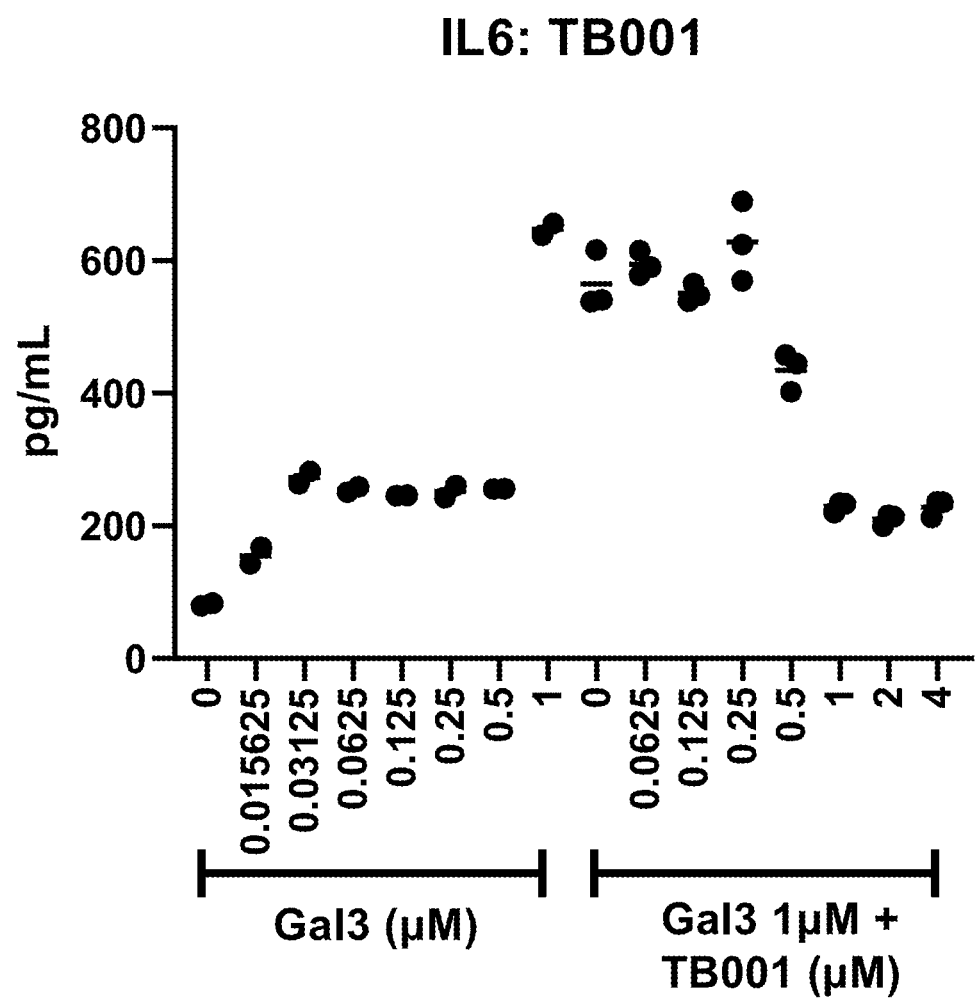
FIG. 27 depicts reduction of IL-6 production by activated neutrophils under pro-inflammatory conditions by treatment with the exemplary anti-Gal3 antibodies TB001 and TB006 compared to the control antibody MOPC21.
Figure 27:
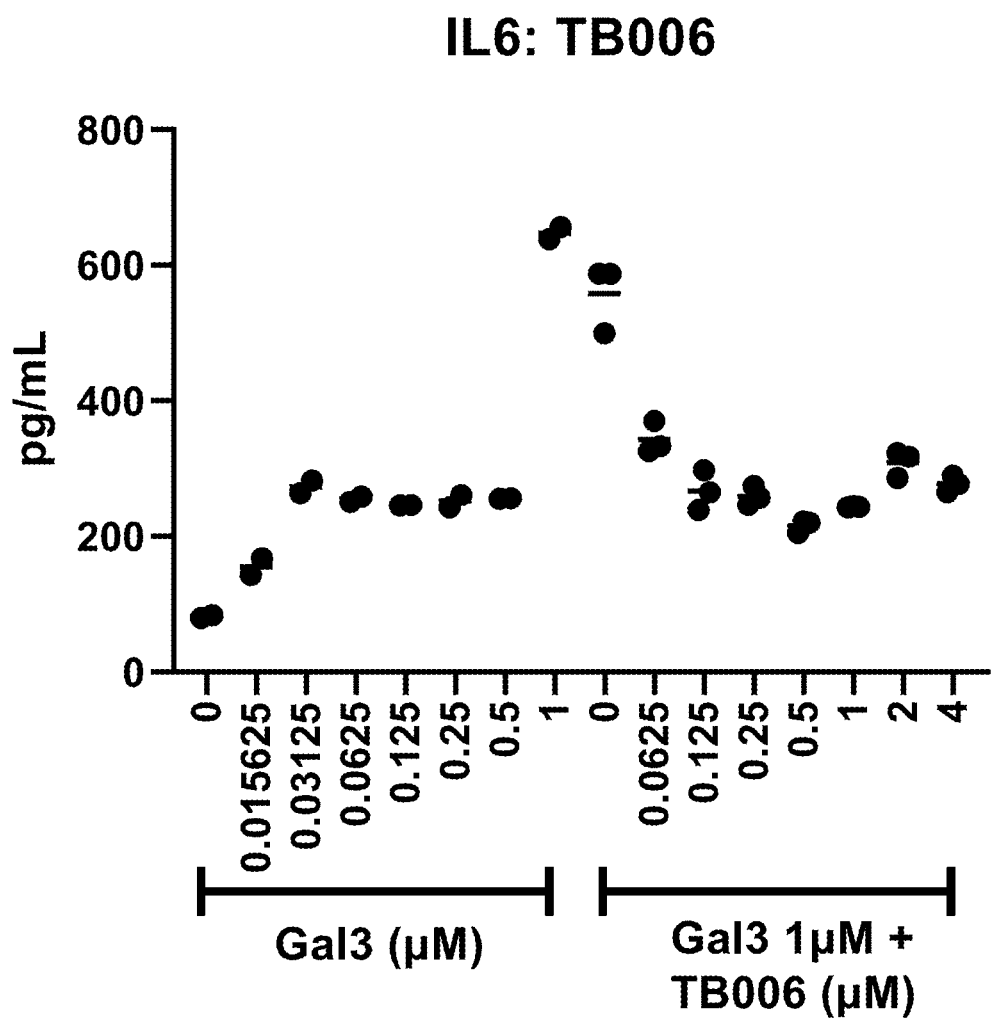
Figure 27:
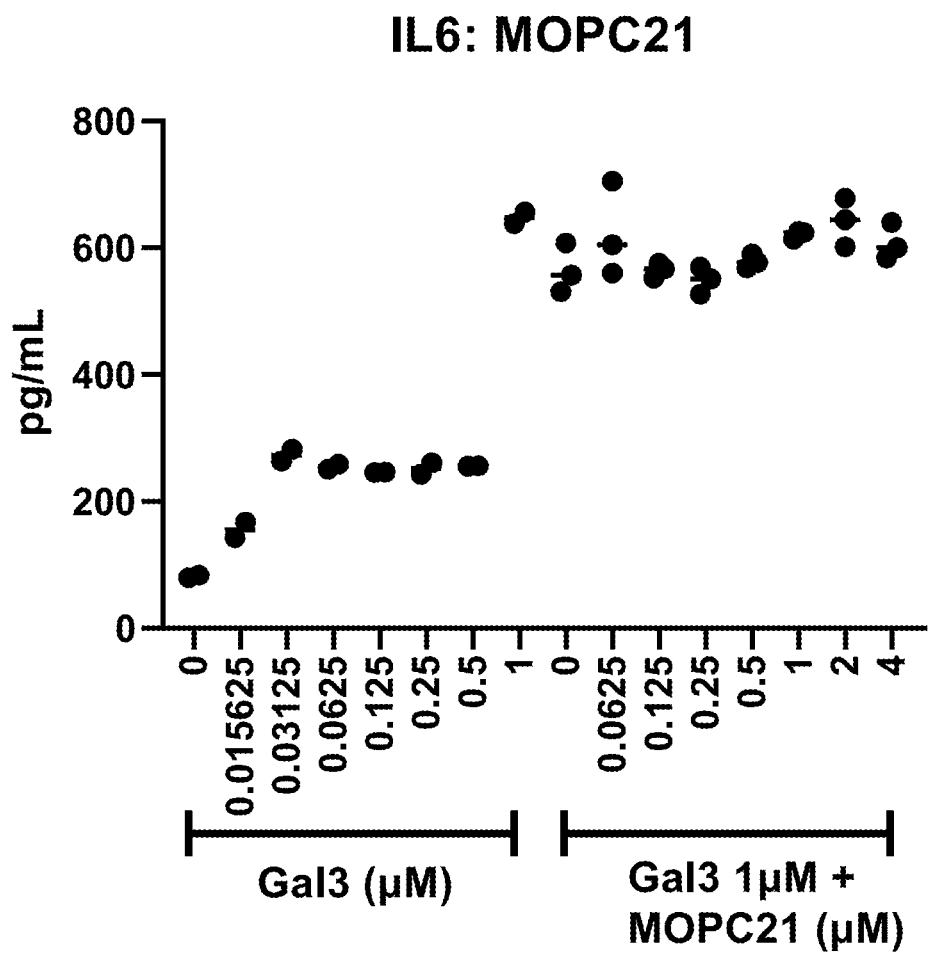

Recombinant Gal3 enhances secretion of TNFα (FIG. 26) and IL-6 (FIG. 27) in a dose-dependent manner. Isotype control co-treatment did not affect cytokine production, but anti-Gal3 antibodies were able to block it. Specifically TNFα was blocked with an $IC_{50}$ of 0.3928 µM and 0.01106 µM for TB001 and TB006, respectively (FIG. 26). IL-6 was blocked with an $IC_{50}$ of 0.5095 μM and 0.03371 μM for TB001 and TB006, respectively (FIG. 27).

Example 17. Gal3 Antibodies Across Various Bins Reduce Cytokine Secretion from Neutrophils Under Pro-Inflammatory Conditions A neutrophil cell line was treated with Gal3 and readouts of neutrophil activation and migration were measured. HL60 promyelocytic cells (ATCC, #CCL-240) were stimulated for four days with 1.3% DMSO to differentiate the cell line into neutrophils. $2 \times 10^5$ cells were then placed in serum-free media on a 96 well plate in triplicate for each condition. 1 μM recombinant human Gal3 (rhGal3) (TrueBinding, #QC200361) was pre-incubated for 30 minutes with 1 μM of a panel of anti-Gal3 antibodies or control media, then 0.1 ng/mL LPS was added for 30 minutes. Finally, the pre-incubated mixture of recombinant Gal3, anti-Gal3 antibodies, and LPS was added to the cells.

Supernatants were collected four hours after treatment for cytokine measurement using a TNFα ELISA kit (R&D, #DY288) and an IL-6 ELISA kit (Thermo Fisher, #88-7066-88), according to manufacturer's instructions. ELISA plates were read with a SpectraMax spectrophotometer and data analyzed with GraphPad Prism. Percent inhibition of cytokine production was calculated and the average from technical replicates is displayed in Table 5.

As seen in Table 5, 27 (56%) of anti-Gal3 antibody clones blocked TNFα by at least 20%. Of those, 19 also blocked IL-6 by at least 20%, with bins 3 and 11 having the most consistent effects on both cytokines. As presented in Table 6, a number of antibodies that blocked TNFα secretion unexpectedly promoted IL-6 production. In particular, this includes clones belonging to bins 7, 8, 17, and some antibodies binding to the C-terminal carbohydrate recognition domain of Gal3.

TABLE 5

Modulation of neutrophil TNFα and IL-6 secretion by exemplary anti-Gal3 antibodies

| Antibody Name | Antibody Bin | % inhibition of TNFα secretion | % inhibition of IL-6 secretion |
|---|---|---|---|
| TB001 | 1 | 81.4 | 45.6 |
| 20H5.A3 | 3 | 60.8 | 77.5 |
| 23H9.2E4 | 3 | 100.0 | 92.6 |
| 2D10-VH0-VL0 | 3 | 39.6 | 21.7 |
| 15G7.2A7 | 5 | 46.1 | 31.0 |
| 20D11.2C6 | 5 | 69.1 | 43.7 |
| 13A12.2E5 | 7 | 61.8 | 39.4 |
| 3B11.2G2 | 7 | 46.1 | −4.6 |
| 14H10.2C9 | 8 | 54.0 | 55.6 |
| 15F10.2D6 | 8 | 73.5 | 51.5 |
| 7D8.2D8 | 8 | −11.5 | 17.4 |
| 846T.14E4 (F846TC.14E4) | 8 | 50.1 | 15.7 |
| 846T.7F10 (F846TC.7F10) | 8 | 72.3 | −2.5 |
| 849.8D10 (F849C.8D10) | 8 | −5.5 | −75.8 |
| 849.2D7 | 10 | 42.7 | 39.0 |
| 24D12.2H9 | 11 | 46.5 | 22.3 |
| 6B3.2D3 | 11 | −1.2 | 0.2 |
| 849.1D2 | 11 | 37.0 | 26.8 |
| 13G4.2F8 | 12 | 83.2 | 55.1 |
| 9H2.2H10 | 12 | −39.2 | −99.1 |
| 846.1B2 (F846C.1B2) | 17 | 43.9 | −9.0 |
| 846.1F5 (F846C.1F5) | 17 | 51.7 | −16.0 |
| 846.1H12 (F846C.1H12) | 17 | 95.3 | 51.8 |
| 846.2H3 (F846C.2H3) | 17 | 62.8 | −49.1 |
| 846T.16B5 (F846TC.16B5) | 17 | −11.4 | −203.6 |
| 847.12C4 | B2C10 | −5.4 | −0.7 |
| 847.15D12 | B2C10 | −152.7 | −71.9 |
| 847.15H11 | B2C10 | 100.0 | 94.7 |
| 847.20H7 | B2C10 | −184.9 | −155.1 |
| 847.27B9 | B2C10 | 70.1 | −84.7 |
| 847.10C9 | CRD | −246.3 | >−1000 |
| 847.11D6 | CRD | −3.1 | 22.7 |
| 847.28D1 | CRD | 80.5 | 78.6 |
| 847.3B3 | CRD | 94.3 | 72.3 |
| 846.2B11 | No binding | −98.0 | −0.5 |
| 846T.4C9 | No binding | −298.6 | −38.3 |
| 847.15F9 | No binding | −178.3 | 16.6 |
| 847.21B11 | No binding | −136.3 | 27.3 |
| 849.4F12 | No binding | −81.5 | 1.2 |
| 849.4B2 | No binding | −161.9 | −9.8 |
| 846.1H5 (F846C.1H5) | Unassigned | −162.0 | −49.7 |
| 847.10B9 (F847C.10B9) | Unassigned | 22.6 | −17.7 |
| 847.11B1 (F847C.11B1) | Unassigned | 53.8 | 49.4 |
| 847.26F5 (F847C.26F5) | Unassigned | −64.7 | 5.8 |
| 847.4B10 (F847C.4B10) | Unassigned | 65.5 | 38.6 |
| 847.14H4 | Unassigned | −181.3 | −71.4 |
| 849.2F12 | Unassigned | 12.8 | 19.2 |
| F847C.21H6 | 1 | 0.2 | −33.8 |

TABLE 6

Exemplary anti-Gal3 antibodies that have differential effects on neutrophil secretion

| Antibody Name | Antibody Bin | % inhibition of TNFα secretion | % inhibition of IL-6 secretion | Comment |
|---|---|---|---|---|
| TB001 | 1 | 81.4 | 45.6 | IL6-Blockers |
| 20H5.A3 | 3 | 60.8 | 77.5 | IL6-Blockers |
| 23H9.2E4 | 3 | 100.0 | 92.6 | IL6-Blockers |
| 2D10-VH0-VL0 | 3 | 39.6 | 21.7 | IL6-Blockers |
| 15G7.2A7 | 5 | 46.1 | 31.0 | IL6-Blockers |
| 20D11.2C6 | 5 | 69.1 | 43.7 | IL6-Blockers |
| 13A12.2E5 | 7 | 61.8 | 39.4 | IL6-Blockers |
| 14H10.2C9 | 8 | 54.0 | 55.6 | IL6-Blockers |
| 15F10.2D6 | 8 | 73.5 | 51.5 | IL6-Blockers |
| 846T.14E4 (F846TC.14E4) | 8 | 50.1 | 15.7 | IL6-Blockers |
| 849.2D7 | 10 | 42.7 | 39.0 | IL6-Blockers |
| 24D12.2H9 | 11 | 46.5 | 22.3 | IL6-Blockers |
| 849.1D2 | 11 | 37.0 | 26.8 | IL6-Blockers |
| 13G4.2F8 | 12 | 83.2 | 55.1 | IL6-Blockers |
| 846.1H12 (F846C.1H12) | 17 | 95.3 | 51.8 | IL6-Blockers |
| 847.15H11 | B2C10 | 100.0 | 94.7 | IL6-Blockers |
| 847.28D1 | CRD | 80.5 | 78.6 | IL6-Blockers |
| 847.3B3 | CRD | 94.3 | 72.3 | IL6-Blockers |
| 847.11B1 (F847C.11B1) | Unassigned | 53.8 | 49.4 | IL6-Blockers |
| 847.4B10 (F847C.4B10) | Unassigned | 65.5 | 38.6 | IL6-Blockers |
| 3B11.2G2 | 7 | 46.1 | −4.6 | IL6-Inducers |
| 846T.7F10 (F846TC.7F10) | 8 | 72.3 | −2.5 | IL6-Inducers |
| 846.1B2 (F846C.1B2) | 17 | 43.9 | −9.0 | IL6-Inducers |

TABLE 6-continued

Exemplary anti-Gal3 antibodies that have differential effects on neutrophil secretion

| Antibody Name | Antibody Bin | % inhibition of TNFα secretion | % inhibition of IL-6 secretion | Comment |
|---|---|---|---|---|
| 846.1F5 (F846C.1F5) | 17 | 51.7 | −16.0 | IL6-Inducers |
| 846.2H3 (F846C.2H3) | 17 | 62.8 | −49.1 | IL6-Inducers |
| 847.27B9 | B2C10 | 70.1 | −84.7 | IL6-Inducers |
| 847.10B9 (F847C.10B9) | Unassigned | 22.6 | −17.7 | IL6-Inducers |

Example 18. Formulations of Anti-Gal3 Antibodies can be Used to Treat a Coronavirus Infection in Humans A patient presents with a coronavirus infection, is experiencing initial symptoms of a coronavirus infection, or is at risk of developing a coronavirus infection. In some embodiments, the coronavirus infection is a SARS-CoV, MERS-CoV, or SARS-CoV-2 infection. In some embodiments, one or more of the pharmaceutical antibody formulations disclosed herein are administered. In some embodiments, the one or more pharmaceutical antibody formulations are administered to the patient enterally, orally, intranasally, parenterally, intracranially, subcutaneously, intramuscularly, intradermally, or intravenously. In some embodiments, the formulation is administered intravenously or subcutaneously.

In some embodiments, the pharmaceutical antibody formulation comprises an anti-Gal3 antibody, and one or more excipients. In some embodiments, the pharmaceutical antibody formulation comprises an anti-Gal3 antibody and one or more of L-histidine, methionine, NaCl, polysorbate, and optionally sucrose and/or mannitol. The pharmaceutical antibody formulation is administered to the patient such that 1 mg (or in the alternative: 5 mg, 10 mg, 20 mg, 40 mg, or 50 mg) as a unit dose is administered to the patient. The formulation is administered daily (or in the alternative: weekly, bi-weekly, or every 10 days) for a duration of 10 months (or in the alternative: 11, 12, 13, 14, 15, 16, 17, or 18 months).

An improvement of the coronavirus infection or symptoms associated with the coronavirus infection is observed in the patient following administration of the pharmaceutical antibody formulation.

Example 19. Stability Test of Antibody Formulations

Short term and long term stability of TB006 antibody formulations and preparations were assessed.

Two bags of TB006 diluted to 0.31 mg/mL in sterile bags pre-filled with 250 mL of 0.9% Sodium Chloride for injection, USP were tested. 4 mL of a 20 mg/mL antibody solution was used. The solutions were confirmed to be colorless and free of particulate matter before the experiment began and throughout the time course. Diluted samples were stored at 25±3° C. and sampled at 0, 0.5 hours, 1 hour, 2 hours, and 4 hours.

Preparations of dilute TB006 antibody formulations in bags ready for parenteral administration were stored at room temperature for 0-4 hours. After 0-4 hours, the preparation maintained at least 60% viability, and no visible particles were observed (Table 7).

TABLE 7

Injection In-use Stability Study Results (Bag 1 and 2)

| | | Bag #1 | | | | | Bag #2 | | | | |
|---|---|---|---|---|---|---|---|---|---|---|---|
| | | 0 h | 0.5 h | 1 h | 2 h | 4 h | 0 h | 0.5 h | 1 h | 2 h | 4 h |
| Appearance | Appearance | Colorless liquid, no visible particle | | | | | Colorless liquid, no visible particle | | | | |
| SoloVPE concentration | Conc. (mg/mL) | 0.28 | 0.30 | 0.30 | 0.30 | 0.30 | 0.31 | 0.30 | 0.30 | 0.30 | 0.30 |
| SEC-HPLC | Monomer (%) | 99.3 | 99.4 | 99.3 | 99.2 | 99.4 | 99.2 | 99.3 | 99.3 | 99.4 | 99.4 |
| cIEF | pI | 7.0 | 7.0 | 7.0 | 7.0 | 7.0 | 7.0 | 7.0 | 7.0 | 7.0 | 7.0 |
| | Acidic peak (%) | 16-16.3 | 17.8-18 | 18-18.3 | 19.8-20 | 19.9-20 | 17.8-18 | 15-15.2 | 16-16.4 | 18.5-19 | 16.7-17 |
| | Main Peak (%) | 76.7-77 | 73-73.2 | 73 | 72 | 72.8-73 | 73.9-74 | 77 | 76-76.3 | 73-73.4 | 76-76.1 |
| | Basic Peak (%) | 7 | 9-9.1 | 8.7-9 | 8-8.2 | 7-7.4 | 8-8.3 | 7.8-8 | 7-7.3 | 8-8.1 | 7-7.2 |
| CE-SDS | CE NR monomer (%) | 100 | 100 | 100 | 100 | 100 | 100 | 100 | 100 | 100 | 100 |
| | CE R HC + LC (%) | 100 | 100 | 100 | 100 | 100 | 100 | 100 | 100 | 100 | 100 |
| ELISA Blocking Assay | IC$_{50}$ (μg/mL) | 1.007 | 1.341 | 1.426 | 1.714 | 1.412 | 1.051 | 1.657 | 1.627 | 1.671 | 1.354 |
| HIAC Subvisible Particles | 2 μM | 890 | 1404 | 2082 | 2010 | 2307 | 156 | 68 | 27 | 60 | 44 |
| | 5 μM | 116 | 221 | 397 | 400 | 471 | 53 | 17 | 2 | 20 | 11 |
| | 10 μM | 12 | 39 | 69 | 83 | 111 | 14 | 4 | 1 | 4 | 2 |
| | 25 μM | 0 | 1.1 | 0 | 1.1 | 4.4 | 0 | 0 | 0 | 1 | 0 |

TB006 antibody formulations were kept for 0-3 months at either 5° C. for long term stability assays, or at 25° C./60% relative humidity (RH) for accelerated stability assays, according to standard FDA conditions. Both the long term and accelerated condition formulations were found to be within acceptable range for various tested parameters (Tables 8 and 9).

TABLE 8

Long-term Stability Testing Results (5° C.)

| Test Item | Method | Acceptance Criteria | Testing results (Batch No. 095I0720) | | |
|---|---|---|---|---|---|
| | | | 0 months | 1 month | 3 months |
| pI | cIEF | pI: 7.0 ± 0.3 | pI: 7.0 | pI: 7.0 | pI: 7.0 |
| Charge Variant | cIEF | Acidic peak: ≤25%<br>Main peak: ≥65%<br>Basic peak: ≤20% | Acidic peak: 18%<br>Main peak: 74%<br>Basic peak: 8% | Acidic peak: 22%<br>Main peak: 71%<br>Basic peak: 7% | Acidic peak: 19%<br>Main peak: 73%<br>Basic peak: 8% |
| Purity | SEC-UPLC | Monomer: ≥90.0%<br>Aggregate: ≤10.0%<br>Fragment: ≤10.0% | Monomer: 99.4%<br>Aggregate: 0.6% | Monomer: 99.4%<br>Aggregate: 0.6% | Monomer: 99.4%<br>Aggregate: 0.6% |
| | Non-reduced CE-SDS | Monomer: ≥90%<br>Fragment: ≤10% | Monomer: 99%<br>Fragment: 1% | Monomer: 99%<br>Fragment: 1% | Monomer: 99%<br>Fragment: 1% |
| | Reduced CE-SDS | LC + HC: ≥90.0%<br>NGHC: ≤10.0% | LC + HC: 100.0% | LC + HC: 100.0% | LC + HC: 100.0% |
| Binding Activity | BLI | 50%-150%<br>kD: 3.0 nM | 3.0 nM | 2.5 nM | 3.0 nM |
| Protein Content | UV | 20.0 ± 2 mg/mL | 20.3 mg/mL | 20.0 mg/mL | 20.1 mg/mL |
| Polysorbate 80 (PS80) | FLD-HPLC | 0.1-0.3 mg/mL | 0.28 mg/mL | 0.24 mg/mL | 0.21 mg/mL |
| Biological Activity | ELISA | 50%-150%<br>IC50: 2.0 µg/mL | 2.5 µg/mL | 1.8 µg/mL | 1.5 µg/mL |
| pH | | 5.8 ± 0.5 | 5.8 | 5.8 | 5.8 |
| Container Content | USP Chap. 697 | ≥2.0 mL | 2.2 mL | 2.2 mL | 2.1 mL |
| Appearance | Visual Method | Clear, colorless to light yellow, essentially free of particles | Clear, colorless, essentially free of particles | Clear, colorless, essentially free of particles | Clear, colorless, essentially free of particles |
| Osmolality | Freezing Point Depression | 230 ± 25 mOsmol/kg | 228 mOsmol/kg | 226 mOsmol/kg | 227 mOsmol/kg |
| Sterility | USP Chap. 71 | Complies with the test for sterility | Pass | N/A | N/A |
| Bacterial Endotoxin | Kinetic-chromogenic assay | ≤0.6 EU/mg | <0.01 EU/mg | N/A | N/A |
| Sub-visible Particles | Light Blockage Method | ≥10 µm: ≤6000 particles/vial<br>≥25 µm: ≤600 particles/vial | ≥10 µm: 9 particles/vial<br>≥25 µm: <1 particle/vial | N/A | ≥10 µm: 6 particles/vial<br>≥25 µm: <1 particle/vial |

TABLE 9

Accelerated Stability Testing Results (25° C./60% RH)

| Test Item | Method | Acceptance Criteria | Testing results (Batch No. 095I0720) | | |
|---|---|---|---|---|---|
| | | | 0 months | 1 month | 3 months |
| pI | cIEF | pI: 7.0 ± 0.3 | pI: 7.0 | pI: 7.0 | pI: 7.0 |
| Charge Variant | cIEF | Acidic peak: ≤25%<br>Main peak: ≥65%<br>Basic peak: ≤20% | Acidic peak: 18%<br>Main peak: 74%<br>Basic peak: 8% | Acidic peak: 22%<br>Main peak: 70%<br>Basic peak: 8% | Acidic peak: 23%<br>Main peak: 70%<br>Basic peak: 7% |
| Purity | SEC-UPLC | Monomer: ≥90.0%<br>Aggregate: ≤10.0%<br>Fragment: ≤10.0% | Monomer: 99.4%<br>Aggregate: 0.6% | Monomer: 99.4%<br>Aggregate: 0.6% | Monomer: 99.3%<br>Aggregate: 0.7% |
| | Non-reduced CE-SDS | Monomer: ≥90%<br>Fragment: ≤10% | Monomer: 99%<br>Fragment: 1% | Monomer: 99%<br>Fragment: 1% | Monomer: 99%<br>Fragment: 1% |
| | Reduced CE-SDS | LC + HC: ≥90.0%<br>NGHC: ≤10.0% | LC + HC: 100.0% | LC + HC: 100.0% | LC + HC: 100.0% |
| Binding Activity | BLI | 50%-150%<br>kD: 3.0 nM | 3.0 nM | 2.5 nM | 3.1 nM |
| Protein Content | UV | 20.0 ± 2 mg/mL | 20.3 mg/mL | 19.9 mg/mL | 20.1 mg/mL |
| Polysorbate 80 (PS80) | FLD-HPLC | 0.1-0.3 mg/mL | 0.28 mg/mL | 0.24 mg/mL | 0.22 mg/mL |
| Biological Activity | ELISA | 50%-150%<br>IC50: 2.0 µg/mL | 2.5 µg/mL | 1.8 µg/mL | 1.5 µg/mL |
| pH | | 5.8 ± 0.5 | 5.8 | 5.9 | 5.9 |
| Container Content | USP Chap. 697 | ≥2.0 mL | 2.2 mL | 2.1 mL | 2.2 mL |

TABLE 9-continued

Accelerated Stability Testing Results (25° C./60% RH)

| Test Item | Method | Acceptance Criteria | Testing results (Batch No. 095I0720) | | |
|---|---|---|---|---|---|
| | | | 0 months | 1 month | 3 months |
| Appearance | Visual Method | Clear, colorless to light yellow, essentially free of particles | Clear, colorless, essentially free of particles | Clear, colorless, essentially free of particles | Clear, colorless, essentially free of particles |
| Osmolality | Freezing Point Depression | 230 ± 25 mOsmol/kg | 228 mOsmol/kg | 229 mOsmol/kg | 231 mOsmol/kg |
| Sterility | USP Chap. 71 | Complies with the test for sterility | Pass | N/A | N/A |
| Bacterial Endotoxin | Kinetic-chromogenic assay | ≤0.6 EU/mg | <0.01 EU/mg | N/A | N/A |
| Sub-visible Particles | Light Blockage Method | ≥10 μm: ≤6000 particles/vial ≥25 μm: ≤600 particles/vial | ≥10 μm: 9 particles/vial ≥25 μm: <1 particle/vial | N/A | ≥10 μm: 7 particles/vial ≥25 μm: <1 particle/vial |

In at least some of the previously described embodiments, one or more elements used in an embodiment can interchangeably be used in another embodiment unless such a replacement is not technically feasible. It will be appreciated by those skilled in the art that various other omissions, additions and modifications may be made to the methods and structures described above without departing from the scope of the claimed subject matter. All such modifications and changes are intended to fall within the scope of the subject matter, as defined by the appended claims.

With respect to the use of substantially any plural and/or singular terms herein, those having skill in the art can translate from the plural to the singular and/or from the singular to the plural as is appropriate to the context and/or application. The various singular/plural permutations may be expressly set forth herein for sake of clarity.

It will be understood by those within the art that, in general, terms used herein, and especially in the appended claims (e.g., bodies of the appended claims) are generally intended as "open" terms (e.g., the term "including" should be interpreted as "including but not limited to," the term "having" should be interpreted as "having at least," the term "includes" should be interpreted as "includes but is not limited to," etc.). It will be further understood by those within the art that if a specific number of an introduced claim recitation is intended, such an intent will be explicitly recited in the claim, and in the absence of such recitation no such intent is present. For example, as an aid to understanding, the following appended claims may contain usage of the introductory phrases "at least one" and "one or more" to introduce claim recitations. However, the use of such phrases should not be construed to imply that the introduction of a claim recitation by the indefinite articles "a" or "an" limits any particular claim containing such introduced claim recitation to embodiments containing only one such recitation, even when the same claim includes the introductory phrases "one or more" or "at least one" and indefinite articles such as "a" or "an" (e.g., "a" and/or "an" should be interpreted to mean "at least one" or "one or more"); the same holds true for the use of definite articles used to introduce claim recitations. In addition, even if a specific number of an introduced claim recitation is explicitly recited, those skilled in the art will recognize that such recitation should be interpreted to mean at least the recited number (e.g., the bare recitation of "two recitations," without other modifiers, means at least two recitations, or two or more recitations). Furthermore, in those instances where a convention analogous to "at least one of A, B, and C, etc." is used, in general such a construction is intended in the sense one having skill in the art would understand the convention (e.g., "a system having at least one of A, B, and C" would include but not be limited to systems that have A alone, B alone, C alone, A and B together, A and C together, B and C together, and/or A, B, and C together, etc.). In those instances where a convention analogous to "at least one of A, B, or C, etc." is used, in general such a construction is intended in the sense one having skill in the art would understand the convention (e.g., "a system having at least one of A, B, or C" would include but not be limited to systems that have A alone, B alone, C alone, A and B together, A and C together, B and C together, and/or A, B, and C together, etc.). It will be further understood by those within the art that virtually any disjunctive word and/or phrase presenting two or more alternative terms, whether in the description, claims, or drawings, should be understood to contemplate the possibilities of including one of the terms, either of the terms, or both terms. For example, the phrase "A or B" will be understood to include the possibilities of "A" or "B" or "A and B."

In addition, where features or aspects of the disclosure are described in terms of Markush groups, those skilled in the art will recognize that the disclosure is also thereby described in terms of any individual member or subgroup of members of the Markush group.

As will be understood by one skilled in the art, for any and all purposes, such as in terms of providing a written description, all ranges disclosed herein also encompass any and all possible sub-ranges and combinations of sub-ranges thereof. Any listed range can be easily recognized as sufficiently describing and enabling the same range being broken down into at least equal halves, thirds, quarters, fifths, tenths, etc. As a non-limiting example, each range discussed herein can be readily broken down into a lower third, middle third and upper third, etc. As will also be understood by one skilled in the art all language such as "up to," "at least," "greater than," "less than," and the like include the number recited and refer to ranges which can be subsequently broken down into sub-ranges as discussed above. Finally, as will be understood by one skilled in the art, a range includes each individual member. Thus, for example, a group having 1-3 articles refers to groups having 1, 2, or 3 articles. Similarly, a group having 1-5 articles refers to groups having 1, 2, 3, 4, or 5 articles, and so forth.

While various aspects and embodiments have been disclosed herein, other aspects and embodiments will be apparent to those skilled in the art. The various aspects and embodiments disclosed herein are for purposes of illustration and are not intended to be limiting, with the true scope and spirit being indicated by the following claims.

A Sequence Listing in electronic format is submitted herewith. Some of the sequences provided in the Sequence Listing may be designated as Artificial Sequences by virtue of being non-naturally occurring fragments or portions of other sequences, including naturally occurring sequences. Some of the sequences provided in the Sequence Listing may be designated as Artificial Sequences by virtue of being combinations of sequences from different origins, such as humanized antibody sequences.

All references cited herein, including but not limited to published and unpublished applications, patents, and literature references, are incorporated herein by reference in their entirety and are hereby made a part of this specification. To the extent publications and patents or patent applications incorporated by reference contradict the disclosure contained in the specification, the specification is intended to supersede and/or take precedence over any such contradictory material.

SEQUENCE LISTING (843 sequences)

SEQ ID NO: 1 - protein, 250 aa, Homo sapiens [sequence omitted]

SEQ ID NO: 2 - protein, 264 aa, Homo sapiens
MHSKTPCGCFKPWKMADNFSLHDALSGSGNPNPQGWPGAWGNQPAGAGGYPGASYPGAYPGQAPPGAYPGQAPPGAYPGAPGAYPGAPAPGVYPGPPSGPGAYPSSGQPSATGAYPATGPYGAPAGPLIVPYNLPLPGGVVPRMLITILGTVKPNANRIALDFQRGNDVAFHFNPRFNENNRRVIVCNTKLDNNWGREERQSVFPFESGKPFKIQVLVEPDHFKVAVNDAHLLQYNHRVKKLNEISKLGISGDIDLTSASYTMI

SEQ ID NO: 3 - protein, 20 aa, Artificial Sequence
  Gal3 Peptide 1
ADNFSLHDALSGSGNPNPQG

SEQ ID NO: 4 - protein, 20 aa, Artificial Sequence
  Gal3 Peptide 2
SGSGNPNPQGWPGAWGNQPA

SEQ ID NO: 5 - protein, 20 aa, Artificial Sequence
  Gal3 Peptide 3
WPGAWGNQPAGAGGYPGASY

SEQ ID NO: 6 - protein, 20 aa, Artificial Sequence
  Gal3 Peptide 4
GAGGYPGASYPGAYPGQAPP

SEQ ID NO: 7 - protein, 20 aa, Artificial Sequence
  Gal3 Peptide 5
PGAYPGQAPPGAYPGQAPPG

SEQ ID NO: 8 - protein, 20 aa, Artificial Sequence
  Gal3 Peptide 6
GAYPGQAPPGAYPGAPGAYP

SEQ ID NO: 9 - protein, 20 aa, Artificial Sequence
  Gal3 Peptide 7
AYPGAPGAYPGAPAPGVYPG

SEQ ID NO: 10 - protein, 20 aa, Artificial Sequence
  Gal3 Peptide 8
GAPAPGVYPGPPSGPGAYPS

SEQ ID NO: 11 - protein, 20 aa, Artificial Sequence
  Gal3 Peptide 9
PPSGPGAYPSSGQPSATGAY

SEQ ID NO: 12 - protein, 20 aa, Artificial Sequence
  Gal3 Peptide 10
SGQPSATGAYPATGPYGAPA

SEQ ID NO: 13 - protein, 20 aa, Artificial Sequence
  Gal3 Peptide 11
PATGPYGAPAGPLIVPYNLP

SEQ ID NO: 14 - protein, 20 aa, Artificial Sequence
  Gal3 Peptide 12
GPLIVPYNLPLPGGVVPRML

SEQ ID NO: 15 - protein, 20 aa, Artificial Sequence
  Gal3 Peptide 13
LPGGVVPRMLITILGTVKPN

SEQ ID NO: 16 - protein, 20 aa, Artificial Sequence
  Gal3 Peptide 14
ITILGTVKPNANRIALDFQR

SEQ ID NO: 17 - protein, 20 aa, Artificial Sequence
  Gal3 Peptide 15
ANRIALDFQRGNDVAFHFNP

SEQ ID NO: 18 - protein, 20 aa, Artificial Sequence
  Gal3 Peptide 16
GNDVAFHFNPRFNENNRRVI

SEQ ID NO: 19 - protein, 20 aa, Artificial Sequence
  Gal3 Peptide 17
RFNENNRRVIVCNTKLDNNW

SEQ ID NO: 20 - protein, 20 aa, Artificial Sequence
  Gal3 Peptide 18
VCNTKLDNNWGREERQSVFP

SEQ ID NO: 21 - protein, 20 aa, Artificial Sequence
  Gal3 Peptide 19
GREERQSVFPFESGKPFKIQ

SEQ ID NO: 22 - protein, 20 aa, Artificial Sequence
  Gal3 Peptide 20
FESGKPFKIQVLVEPDHFKV

SEQ ID NO: 23 - protein, 20 aa, Artificial Sequence
  Gal3 Peptide 21
VLVEPDHFKVAVNDAHLLQY

SEQ ID NO: 24 - protein, 20 aa, Artificial Sequence
  Gal3 Peptide 22
AVNDAHLLQYNHRVKKLNEI

SEQ ID NO: 25 - protein, 20 aa, Artificial Sequence
  Gal3 Peptide 23
NHRVKKLNEISKLGISGDID

SEQ ID NO: 26 - protein, 19 aa, Artificial Sequence
  Gal3 Peptide 24
SKLGISGDIDLTSASYTMI

SEQ ID NO: 27 - protein, 7 aa, Artificial Sequence
  VH_CDR1_1
GYTFTNY

SEQ ID NO: 28 - protein, 7 aa, Artificial Sequence
  VH_CDR1_2
GFSLTSY

SEQ ID NO: 29 - protein, 8 aa, Artificial Sequence
  VH_CDR1_3
GYTFTNYW

SEQ ID NO: 30 - protein, 8 aa, Artificial Sequence
  VH_CDR1_4
GYTFTNYG

SEQ ID NO: 31 - protein, 7 aa, Artificial Sequence
  VH_CDR1_5
GYSFTNY

SEQ ID NO: 32 - protein, 7 aa, Artificial Sequence
  VH_CDR1_6
GYTFTDY

SEQ ID NO: 33 - protein, 7 aa, Artificial Sequence
  VH_CDR1_7
GYKFKTY

SEQ ID NO: 34 - protein, 7 aa, Artificial Sequence
  VH_CDR1_8
GYTFTTY

SEQ ID NO: 35 - protein, 7 aa, Artificial Sequence
  VH_CDR1_9
GFAFSSY

SEQ ID NO: 36 - protein, 7 aa, Artificial Sequence
  VH_CDR1_10
GYTFTDF

SEQ ID NO: 37 - protein, 7 aa, Artificial Sequence
  VH_CDR1_11
GYAFTTY

SEQ ID NO: 38 - protein, 7 aa, Artificial Sequence
  VH_CDR1_12
GFTFSSY

SEQ ID NO: 39 - protein, 8 aa, Artificial Sequence
  VH_CDR1_13
GFSLTSYG

SEQ ID NO: 40 - protein, 7 aa, Artificial Sequence
  VH_CDR1_14
GYTFTSY

SEQ ID NO: 41 - protein, 7 aa, Artificial Sequence
  VH_CDR1_15
GYTFSDY

SEQ ID NO: 42 - protein, 8 aa, Artificial Sequence
  VH_CDR1_16
GYTFTNFG

SEQ ID NO: 43 - protein, 8 aa, Artificial Sequence
  VH_CDR1_17
GFTFSSYA

SEQ ID NO: 44 - protein, 10 aa, Artificial Sequence
  VH_CDR1_18
GFSLSTSGMG

SEQ ID NO: 45 - protein, 8 aa, Artificial Sequence
  VH_CDR1_19
GFTFSNYG

SEQ ID NO: 46 - protein, 8 aa, Artificial Sequence
  VH_CDR1_20
GYIFTNYG

SEQ ID NO: 47 - protein, 8 aa, Artificial Sequence
  VH_CDR1_21
GNTFTDHN

SEQ ID NO: 48 - protein, 8 aa, Artificial Sequence
  VH_CDR1_22
GYTFTSYW

SEQ ID NO: 49 - protein, 10 aa, Artificial Sequence
  VH_CDR1_23
GFSLSTFGMG

SEQ ID NO: 50 - protein, 8 aa, Artificial Sequence
  VH_CDR1_24
GYTFTSYD

SEQ ID NO: 51 - protein, 8 aa, Artificial Sequence
  VH_CDR1_25
GFTFSNYW

SEQ ID NO: 52 - protein, 8 aa, Artificial Sequence
  VH_CDR1_26
GYTFTSYV

SEQ ID NO: 53 - protein, 8 aa, Artificial Sequence
  VH_CDR1_27
GYSFTNYI

SEQ ID NO: 54 - protein, 8 aa, Artificial Sequence
  VH_CDR1_28
GYTFRSYD

SEQ ID NO: 55 - protein, 8 aa, Artificial Sequence
  VH_CDR1_29
GFTFSNFW

SEQ ID NO: 56 - protein, 8 aa, Artificial Sequence
  VH_CDR1_30
EYAFNNYM

SEQ ID NO: 57 - protein, 8 aa, Artificial Sequence
  VH_CDR1_31
GYSFTGYT

SEQ ID NO: 58 - protein, 8 aa, Artificial Sequence
  VH_CDR1_32
GFSLINYG

SEQ ID NO: 59 - protein, 8 aa, Artificial Sequence
  VH_CDR1_33
GYTFNNYW

SEQ ID NO: 60 - protein, 8 aa, Artificial Sequence
  VH_CDR1_34
GFSLSSYG

SEQ ID NO: 61 - protein, 8 aa, Artificial Sequence
  VH_CDR1_35
GYSFTNYW

SEQ ID NO: 62 - protein, 8 aa, Artificial Sequence
  VH_CDR1_36
GYSFTSYW

SEQ ID NO: 63 - protein, 9 aa, Artificial Sequence
  VH_CDR1_37
GYSITSGYY

SEQ ID NO: 64 - protein, 8 aa, Artificial Sequence
  VH_CDR1_38
GFNIKDYY

SEQ ID NO: 65 - protein, 8 aa, Artificial Sequence
  VH_CDR1_39
RYTFTDYN

SEQ ID NO: 66 - protein, 8 aa, Artificial Sequence
  VH_CDR1_40
GYTFTIFG

SEQ ID NO: 67 - protein, 8 aa, Artificial Sequence
  VH_CDR1_41
GYTFTSSW

SEQ ID NO: 68 - protein, 8 aa, Artificial Sequence
  VH_CDR1_42
GYTFTGYW

SEQ ID NO: 69 - protein, 8 aa, Artificial Sequence
  VH_CDR1_43
GYSFTDYN

SEQ ID NO: 70 - protein, 8 aa, Artificial Sequence
  VH_CDR1_44
GFSLTIYG

SEQ ID NO: 71 - protein, 6 aa, Artificial Sequence
  VH_CDR2_1
NTNTGE

SEQ ID NO: 72 - protein, 8 aa, Artificial Sequence
  VH_CDR2_2
IYPGSGNT

SEQ ID NO: 73 - protein, 8 aa, Artificial Sequence
  VH_CDR2_3
IYPGTGNT

SEQ ID NO: 74 - protein, 8 aa, Artificial Sequence
  VH_CDR2_4
INTYSGVP

SEQ ID NO: 75 - protein, 8 aa, Artificial Sequence
  VH_CDR2_5
ISDGGVYT

SEQ ID NO: 76 - protein, 8 aa, Artificial Sequence
  VH_CDR2_6
INPKNGGI

SEQ ID NO: 77 - protein, 8 aa, Artificial Sequence
  VH_CDR2_7
VNTYSGVP

SEQ ID NO: 78 - protein, 8 aa, Artificial Sequence
  VH_CDR2_8
IYPGSNDT

SEQ ID NO: 79 - protein, 8 aa, Artificial Sequence
  VH_CDR2_9
ISDGGIYT

SEQ ID NO: 80 - protein, 8 aa, Artificial Sequence
  VH_CDR2_10
INTHSGVP

SEQ ID NO: 81 - protein, 7 aa, Artificial Sequence
  VH_CDR2_11
IWSGGST

SEQ ID NO: 82 - protein, 8 aa, Artificial Sequence
  VH_CDR2_12
IDPSDSET

SEQ ID NO: 83 - protein, 8 aa, Artificial Sequence
  VH_CDR2_13
IHPNSGST

SEQ ID NO: 84 - protein, 8 aa, Artificial Sequence
  VH_CDR2_14
INPNNGGT

SEQ ID NO: 85 - protein, 8 aa, Artificial Sequence
  VH_CDR2_15
IYPVSVNT

SEQ ID NO: 86 - protein, 8 aa, Artificial Sequence
  VH_CDR2_16
INTYTGEP

SEQ ID NO: 87 - protein, 7 aa, Artificial Sequence
  VH_CDR2_17
ISSGGDT

SEQ ID NO: 88 - protein, 7 aa, Artificial Sequence
  VH_CDR2_18
IWWDDDK

SEQ ID NO: 89 - protein, 8 aa, Artificial Sequence
  VH_CDR2_19
ISSGGSYT

SEQ ID NO: 90 - protein, 8 aa, Artificial Sequence
  VH_CDR2_20
IYPYNGGT

SEQ ID NO: 91 - protein, 7 aa, Artificial Sequence
  VH_CDR2_21
ISSGGST

SEQ ID NO: 92 - protein, 8 aa, Artificial Sequence
  VH_CDR2_22
IYPGSSSI

SEQ ID NO: 93 - protein, 8 aa, Artificial Sequence
  VH_CDR2_23
IYPGDGST

SEQ ID NO: 94 - protein, 10 aa, Artificial Sequence
  VH_CDR2_24
IRLKSNNYAT

SEQ ID NO: 95 - protein, 8 aa, Artificial Sequence
  VH_CDR2_25
INTNTGES

SEQ ID NO: 96 - protein, 10 aa, Artificial Sequence
  VH_CDR2_26
LRLKSNNYAT

SEQ ID NO: 97 - protein, 8 aa, Artificial Sequence
  VH_CDR2_27
INPYNDGT

SEQ ID NO: 98 - protein, 8 aa, Artificial Sequence
  VH_CDR2_28
IFPGEGIS

SEQ ID NO: 99 - protein, 8 aa, Artificial Sequence
  VH_CDR2_29
IFPGDGTT

SEQ ID NO: 100 - protein, 8 aa, Artificial Sequence
  VH_CDR2_30
INPGSGAT

SEQ ID NO: 101 - protein, 8 aa, Artificial Sequence
  VH_CDR2_31
INPYNGGT

SEQ ID NO: 102 - protein, 8 aa, Artificial Sequence
  VH_CDR2_32
FLPGDGSS

SEQ ID NO: 103 - protein, 7 aa, Artificial Sequence
  VH_CDR2_33
IWAGGST

SEQ ID NO: 104 - protein, 8 aa, Artificial Sequence
  VH_CDR2_34
INTNTGEP

SEQ ID NO: 105 - protein, 7 aa, Artificial Sequence
  VH_CDR2_35
ISYDGRN

SEQ ID NO: 106 - protein, 8 aa, Artificial Sequence
  VH_CDR2_36
IYPEDDET

SEQ ID NO: 107 - protein, 8 aa, Artificial Sequence
  VH_CDR2_37
IYPNNGGT

SEQ ID NO: 108 - protein, 8 aa, Artificial Sequence
  VH_CDR2_38
VNTYTGEP

SEQ ID NO: 109 - protein, 8 aa, Artificial Sequence
  VH_CDR2_39
IDPYNDAT

SEQ ID NO: 110 - protein, 7 aa, Artificial Sequence
  VH_CDR2_40
VAWDDKK

SEQ ID NO: 111 - protein, 7 aa, Artificial Sequence
  VH_CDR2_41
ISSGDSP

SEQ ID NO: 112 - protein, 9 aa, Artificial Sequence
  VH_CDR3_1
APYDNFFAY

SEQ ID NO: 113 - protein, 9 aa, Artificial Sequence
  VH_CDR3_2
STAPGGFDV

SEQ ID NO: 114 - protein, 15 aa, Artificial Sequence
  VH_CDR3_3
ARFAYYYGSGGYFDY

SEQ ID NO: 115 - protein, 12 aa, Artificial Sequence
  VH_CDR3_4
ARDGNYGDPMDY

SEQ ID NO: 116 - protein, 10 aa, Artificial Sequence
  VH_CDR3_5
STPYEYDGAY

SEQ ID NO: 117 - protein, 6 aa, Artificial Sequence
  VH_CDR3_6
VRDGGY

SEQ ID NO: 118 - protein, 9 aa, Artificial Sequence
  VH_CDR3_7
ARGPYAMDY

SEQ ID NO: 119 - protein, 8 aa, Artificial Sequence
  VH_CDR3_8
TSGYGFPY

SEQ ID NO: 120 - protein, 13 aa, Artificial Sequence
  VH_CDR3_9
ANYFGCSGWFFDV

SEQ ID NO: 121 - protein, 12 aa, Artificial Sequence
  VH_CDR3_10
TRDGNDGDAMDN

SEQ ID NO: 122 - protein, 14 aa, Artificial Sequence
  VH_CDR3_11
AKGPYDYDLGWFAY

SEQ ID NO: 123 - protein, 8 aa, Artificial Sequence
  VH_CDR3_12
ARHGYYDY

SEQ ID NO: 124 - protein, 12 aa, Artificial Sequence
  VH_CDR3_13
TRWGIYYYARDY

SEQ ID NO: 125 - protein, 10 aa, Artificial Sequence
  VH_CDR3_14
AVPYEYDGAY

SEQ ID NO: 126 - protein, 10 aa, Artificial Sequence
  VH_CDR3_15
ATPYEYDGAY

SEQ ID NO: 127 - protein, 5 aa, Artificial Sequence
  VH_CDR3_16
AYLDY

SEQ ID NO: 128 - protein, 14 aa, Artificial Sequence
  VH_CDR3_17
AKSPDGYDVAWFGY

SEQ ID NO: 129 - protein, 15 aa, Artificial Sequence
  VH_CDR3_18
ARWGGYAGDYYAMDF

SEQ ID NO: 130 - protein, 15 aa, Artificial Sequence
  VH_CDR3_19
ARWGGYDGDYYAMDY

SEQ ID NO: 131 - protein, 15 aa, Artificial Sequence
  VH_CDR3_20
ARWGGYAGDYYAMDY

SEQ ID NO: 132 - protein, 10 aa, Artificial Sequence
  VH_CDR3_21
ASYGNSLFDY

SEQ ID NO: 133 - protein, 7 aa, Artificial Sequence
  VH_CDR3_22
VRYTMDY

SEQ ID NO: 134 - protein, 16 aa, Artificial Sequence
  VH_CDR3_23
ARNLYDGSYGYYAMDY

SEQ ID NO: 135 - protein, 16 aa, Artificial Sequence
  VH_CDR3_24
ARHAHYYGVSPYYFDY

SEQ ID NO: 136 - protein, 12 aa, Artificial Sequence
  VH_CDR3_25
AKFGNYVGAMDY

SEQ ID NO: 137 - protein, 13 aa, Artificial Sequence
  VH_CDR3_26
ARGEYDYLAWFAY

SEQ ID NO: 138 - protein, 11 aa, Artificial Sequence
  VH_CDR3_27
TRFTTVVEMDY

SEQ ID NO: 139 - protein, 5 aa, Artificial Sequence
  VH_CDR3_28
ARWGY

SEQ ID NO: 140 - protein, 13 aa, Artificial Sequence
  VH_CDR3_29
ARIDYGDYVGFAY

SEQ ID NO: 141 - protein, 11 aa, Artificial Sequence
  VH_CDR3_30
AREAASNAMDY

SEQ ID NO: 142 - protein, 13 aa, Artificial Sequence
  VH_CDR3_31
TRHYGFPYWYFDV

SEQ ID NO: 143 - protein, 11 aa, Artificial Sequence
  VH_CDR3_32
QPGGVTGTLTT

SEQ ID NO: 144 - protein, 7 aa, Artificial Sequence
  VH_CDR3_33
ARYPMDY

SEQ ID NO: 145 - protein, 11 aa, Artificial Sequence
  VH_CDR3_34
ARLLFYYAMDY

SEQ ID NO: 146 - protein, 11 aa, Artificial Sequence
  VH_CDR3_35
AREATAGAMDY

SEQ ID NO: 147 - protein, 11 aa, Artificial Sequence
  VH_CDR3_36
AREGAGSWFAY

SEQ ID NO: 148 - protein, 7 aa, Artificial Sequence
  VH_CDR3_37
TYNDLGY

SEQ ID NO: 149 - protein, 16 aa, Artificial Sequence
  VH_CDR3_38
ARKDDYYGSSPYALDY

SEQ ID NO: 150 - protein, 9 aa, Artificial Sequence
  VH_CDR3_39
VRDDYDSDY

SEQ ID NO: 151 - protein, 14 aa, Artificial Sequence
  VH_CDR3_40
ARIYYYGRGYAMDY

SEQ ID NO: 152 - protein, 15 aa, Artificial Sequence
  VH_CDR3_41
ARGDYYYGTRGPMDY

SEQ ID NO: 153 - protein, 8 aa, Artificial Sequence
  VH_CDR3_42
ARWGAMDY

SEQ ID NO: 154 - protein, 15 aa, Artificial Sequence
  VH_CDR3_43
ARDRASLLRPGAMDY

SEQ ID NO: 155 - protein, 11 aa, Artificial Sequence
  VH_CDR3_44
ARLDYDYDEDY

SEQ ID NO: 156 - protein, 14 aa, Artificial Sequence
  VH_CDR3_45
ASPPSGYDYDVFAS

SEQ ID NO: 157 - protein, 14 aa, Artificial Sequence
  VH_CDR3_46
ASPPSGYDYDVFAY

SEQ ID NO: 158 - protein, 14 aa, Artificial Sequence
  VH_CDR3_47
AKPPYDYDGAWFAY

SEQ ID NO: 159 - protein, 7 aa, Artificial Sequence
  VH_CDR3_48
ATGRPDY

SEQ ID NO: 160 - protein, 7 aa, Artificial Sequence
  VH_CDR3_49
AKGRPDY

SEQ ID NO: 161 - protein, 11 aa, Artificial Sequence
  VH_CDR3_50
AGYDFLWYFDV

SEQ ID NO: 162 - protein, 12 aa, Artificial Sequence
  VH_CDR3_51
ARSGGYYVWFAY

SEQ ID NO: 163 - protein, 14 aa, Artificial Sequence
  VH_CDR3_52
ARSYYDGSYDAMDY

SEQ ID NO: 164 - protein, 7 aa, Artificial Sequence
  VH_CDR3_53
ARGWFAY

SEQ ID NO: 165 - protein, 14 aa, Artificial Sequence
  VH_CDR3_54
AKPPHDYDQAWFAY

SEQ ID NO: 166 - protein, 9 aa, Artificial Sequence
  VH_CDR3_55
VNSNYESGY

SEQ ID NO: 167 - protein, 9 aa, Artificial Sequence
  VH_CDR3_56
ANSNYASGS

SEQ ID NO: 168 - protein, 13 aa, Artificial Sequence
  VH_CDR3_57
ARWGRYEYYAMDY

SEQ ID NO: 169 - protein, 9 aa, Artificial Sequence
  VH_CDR3_58
TMTGGPINY

SEQ ID NO: 170 - protein, 16 aa, Artificial Sequence
  VL-CDR1_1
RSSKSLLYKDGKTYLN

SEQ ID NO: 171 - protein, 11 aa, Artificial Sequence
  VL-CDR1_2
KSLLHSDGITY

SEQ ID NO: 172 - protein, 6 aa, Artificial Sequence
  VL-CDR1_3
QGINSN

SEQ ID NO: 173 - protein, 11 aa, Artificial Sequence
  VL-CDR1_4
QSLLYTNGKTY

SEQ ID NO: 174 - protein, 11 aa, Artificial Sequence
  VL-CDR1_5
QSLFDSDGKTY

SEQ ID NO: 175 - protein, 11 aa, Artificial Sequence
  VL-CDR1_6
QSIVHNNGNTY

SEQ ID NO: 176 - protein, 6 aa, Artificial Sequence
  VL-CDR1_7
QGINNY

SEQ ID NO: 177 - protein, 6 aa, Artificial Sequence
  VL-CDR1_8
QNIYIW

SEQ ID NO: 178 - protein, 6 aa, Artificial Sequence
  VL-CDR1_9
QDISNY

SEQ ID NO: 179 - protein, 11 aa, Artificial Sequence
  VL-CDR1_10
QSIVHSNGNTY

SEQ ID NO: 180 - protein, 11 aa, Artificial Sequence
  VL-CDR1_11
QSLLYTDGKTY

SEQ ID NO: 181 - protein, 6 aa, Artificial Sequence
  VL-CDR1_12
QSVSND

SEQ ID NO: 182 - protein, 6 aa, Artificial Sequence
  VL-CDR1_13
QGISNY

SEQ ID NO: 183 - protein, 6 aa, Artificial Sequence
  VL-CDR1_14
QDVSTA

SEQ ID NO: 184 - protein, 6 aa, Artificial Sequence
  VL-CDR1_15
QNVGTN

SEQ ID NO: 185 - protein, 11 aa, Artificial Sequence
  VL-CDR1_16
QSLFHSDGKTY

SEQ ID NO: 186 - protein, 6 aa, Artificial Sequence
  VL-CDR1_17
QNINIW

SEQ ID NO: 187 - protein, 11 aa, Artificial Sequence
  VL-CDR1_18
QSLLHSDGKTY

SEQ ID NO: 188 - protein, 6 aa, Artificial Sequence
  VL-CDR1_19
QDVRTA

SEQ ID NO: 189 - protein, 12 aa, Artificial Sequence
  VL-CDR1_20
QSVLYSSNQKNY

SEQ ID NO: 190 - protein, 12 aa, Artificial Sequence
  VL-CDR1_21
QSVLYSSSQKNY

SEQ ID NO: 191 - protein, 11 aa, Artificial Sequence
  VL-CDR1_22
QSLVHNSGNTY

SEQ ID NO: 192 - protein, 9 aa, Artificial Sequence
  VL-CDR1_23
TGAVTTSNY

SEQ ID NO: 193 - protein, 11 aa, Artificial Sequence
  VL-CDR1_24
KSLLHTNGITF

SEQ ID NO: 194 - protein, 12 aa, Artificial Sequence
  VL-CDR1_25
QSLLNSSNQKNY

SEQ ID NO: 195 - protein, 6 aa, Artificial Sequence
  VL-CDR1_26
QNINVW

SEQ ID NO: 196 - protein, 6 aa, Artificial Sequence
  VL-CDR1_27
IDIDDD

SEQ ID NO: 197 - protein, 11 aa, Artificial Sequence
  VL-CDR1_28
QDIVHSSGNTY

SEQ ID NO: 198 - protein, 11 aa, Artificial Sequence
  VL-CDR1_29
KSLLYSNGITY

SEQ ID NO: 199 - protein, 10 aa, Artificial Sequence
  VL-CDR1_30
KSVSTSGYSY

SEQ ID NO: 200 - protein, 10 aa, Artificial Sequence
  VL-CDR1_31
ESVDSYGNSF

SEQ ID NO: 201 - protein, 11 aa, Artificial Sequence
  VL-CDR1_32
QSLLYSNGKTY

SEQ ID NO: 202 - protein, 6 aa, Artificial Sequence
  VL-CDR1_33
QGISSN

SEQ ID NO: 203 - protein, 10 aa, Artificial Sequence
  VL-CDR1_34
KSVSTSGYSC

SEQ ID NO: 204 - protein, 11 aa, Artificial Sequence
  VL-CDR1_35
QSLLYSDGKTY

SEQ ID NO: 205 - protein, 10 aa, Artificial Sequence
  VL-CDR1_36
ESVENHVNSF

SEQ ID NO: 206 - protein, 5 aa, Artificial Sequence
  VL-CDR1_37
SSVTY

SEQ ID NO: 207 - protein, 10 aa, Artificial Sequence
  VL-CDR1_38
ESLDNSGISF

SEQ ID NO: 208 - protein, 6 aa, Artificial Sequence
  VL-CDR1_39
QDVSTT

SEQ ID NO: 209 - protein, 6 aa, Artificial Sequence
  VL-CDR1_40
QNVGIN

SEQ ID NO: 210 - protein, 11 aa, Artificial Sequence
  VL-CDR1_41
QSLLDSDGKTY

SEQ ID NO: 211 - protein, 6 aa, Artificial Sequence
  VL-CDR1_42
GNIHNY

SEQ ID NO: 212 - protein, 6 aa, Artificial Sequence
  VL-CDR1_43
QSVSSD

SEQ ID NO: 213 - protein, 11 aa, Artificial Sequence
  VL-CDR1_44
QSLLYINGKTY

SEQ ID NO: 214 - protein, 11 aa, Artificial Sequence
  VL-CDR1_45
RSLLHSNGYTY

SEQ ID NO: 215 - protein, 11 aa, Artificial Sequence
  VL-CDR1_46
RSLLDSDGKTY

SEQ ID NO: 216 - protein, 6 aa, Artificial Sequence
  VL-CDR1_47
QDVSSV

SEQ ID NO: 217 - protein, 6 aa, Artificial Sequence
  VL-CDR1_48
QIINNN

SEQ ID NO: 218 - protein, 10 aa, Artificial Sequence
  VL-CDR1_49
KSVTTSAYSY

SEQ ID NO: 219 - protein, 11 aa, Artificial Sequence
  VL-CDR1_50
QSLLDRDGKTY

SEQ ID NO: 220 - protein, 6 aa, Artificial Sequence
  VL-CDR1_51
QSVSNE

SEQ ID NO: 221 - protein, 7 aa, Artificial Sequence
  VL-CDR2_1
LMSTHAS

SEQ ID NO: 222 - protein, 3 aa, Artificial Sequence
  VL-CDR2_2
RMS

SEQ ID NO: 223 - protein, 3 aa, Artificial Sequence
  VL-CDR2_3
HAT

SEQ ID NO: 224 - protein, 3 aa, Artificial Sequence
  VL-CDR2_4
LLS

SEQ ID NO: 225 - protein, 3 aa, Artificial Sequence
  VL-CDR2_5
LVS

SEQ ID NO: 226 - protein, 3 aa, Artificial Sequence
  VL-CDR2_6
KVS

SEQ ID NO: 227 - protein, 3 aa, Artificial Sequence
  VL-CDR2_7
YAS

SEQ ID NO: 228 - protein, 3 aa, Artificial Sequence
  VL-CDR2_8
KAS

SEQ ID NO: 229 - protein, 3 aa, Artificial Sequence
  VL-CDR2_9
YTS

SEQ ID NO: 230 - protein, 3 aa, Artificial Sequence
  VL-CDR2_10
WAS

SEQ ID NO: 231 - protein, 3 aa, Artificial Sequence
  VL-CDR2_11
GAS

SEQ ID NO: 232 - protein, 3 aa, Artificial Sequence
  VL-CDR2_12
GIN

SEQ ID NO: 233 - protein, 3 aa, Artificial Sequence
  VL-CDR2_13
QMS

SEQ ID NO: 234 - protein, 3 aa, Artificial Sequence
  VL-CDR2_14
FAS

SEQ ID NO: 235 - protein, 3 aa, Artificial Sequence
  VL-CDR2_15
EGN

SEQ ID NO: 236 - protein, 3 aa, Artificial Sequence
  VL-CDR2_16
GTN

SEQ ID NO: 237 - protein, 3 aa, Artificial Sequence
  VL-CDR2_17
LAS

SEQ ID NO: 238 - protein, 3 aa, Artificial Sequence
  VL-CDR2_18
LVC

SEQ ID NO: 239 - protein, 3 aa, Artificial Sequence
  VL-CDR2_19
HGT

SEQ ID NO: 240 - protein, 3 aa, Artificial Sequence
  VL-CDR2_20
YGT

SEQ ID NO: 241 - protein, 3 aa, Artificial Sequence
  VL-CDR2_21
RAS

SEQ ID NO: 242 - protein, 3 aa, Artificial Sequence
  VL-CDR2_22
ATS

SEQ ID NO: 243 - protein, 3 aa, Artificial Sequence
  VL-CDR2_23
AAS

SEQ ID NO: 244 - protein, 3 aa, Artificial Sequence
  VL-CDR2_24
SAS

SEQ ID NO: 245 - protein, 3 aa, Artificial Sequence
  VL-CDR2_25
NVK

SEQ ID NO: 246 - protein, 3 aa, Artificial Sequence
  VL-CDR2_26
SAK

SEQ ID NO: 247 - protein, 3 aa, Artificial Sequence
  VL-CDR2_27
QAS

SEQ ID NO: 248 - protein, 9 aa, Artificial Sequence
  VL-CDR3_1
QQLVDYPLT

SEQ ID NO: 249 - protein, 9 aa, Artificial Sequence
  VL-CDR3_2
AQMLEFPLT

SEQ ID NO: 250 - protein, 9 aa, Artificial Sequence
  VL-CDR3_3
VQYAQFPPT

SEQ ID NO: 251 - protein, 9 aa, Artificial Sequence
  VL-CDR3_4
LQSTHFPLT

SEQ ID NO: 252 - protein, 9 aa, Artificial Sequence
  VL-CDR3_5
WQGTHFPLT

SEQ ID NO: 253 - protein, 9 aa, Artificial Sequence
  VL-CDR3_6
FQGSHVPLT

SEQ ID NO: 254 - protein, 9 aa, Artificial Sequence
  VL-CDR3_7
QQYSQVPYT

SEQ ID NO: 255 - protein, 9 aa, Artificial Sequence
  VL-CDR3_8
LQGQSYPLT

SEQ ID NO: 256 - protein, 9 aa, Artificial Sequence
  VL-CDR3_9
QQYSKLPYT

SEQ ID NO: 257 - protein, 9 aa, Artificial Sequence
  VL-CDR3_10
AQMIEFPLT

SEQ ID NO: 258 - protein, 9 aa, Artificial Sequence
  VL-CDR3_11
QQDYTSPYT

SEQ ID NO: 259 - protein, 9 aa, Artificial Sequence
  VL-CDR3_12
QQYSELPYT

SEQ ID NO: 260 - protein, 9 aa, Artificial Sequence
  VL-CDR3_13
QQHYTTPLT

SEQ ID NO: 261 - protein, 9 aa, Artificial Sequence
  VL-CDR3_14
EQYSNFPLT

SEQ ID NO: 262 - protein, 9 aa, Artificial Sequence
  VL-CDR3_15
QQYSSYPWT

SEQ ID NO: 263 - protein, 8 aa, Artificial Sequence
  VL-CDR3_16
HQYLSSLT

SEQ ID NO: 264 - protein, 9 aa, Artificial Sequence
  VL-CDR3_17
SQSTHVPPT

SEQ ID NO: 265 - protein, 9 aa, Artificial Sequence
  VL-CDR3_18
ALWYSNHWV

SEQ ID NO: 266 - protein, 9 aa, Artificial Sequence
  VL-CDR3_19
AQNLELPWT

SEQ ID NO: 267 - protein, 9 aa, Artificial Sequence
  VL-CDR3_20
QQHYSTPYT

SEQ ID NO: 268 - protein, 9 aa, Artificial Sequence
  VL-CDR3_21
QQGQSYPYT

SEQ ID NO: 269 - protein, 9 aa, Artificial Sequence
  VL-CDR3_22
LQSDNKPLT

SEQ ID NO: 270 - protein, 9 aa, Artificial Sequence
  VL-CDR3_23
ALWYSNHLV

SEQ ID NO: 271 - protein, 9 aa, Artificial Sequence
  VL-CDR3_24
FQGSHVPPT

SEQ ID NO: 272 - protein, 9 aa, Artificial Sequence
  VL-CDR3_25
QHSRELPLT

SEQ ID NO: 273 - protein, 9 aa, Artificial Sequence
  VL-CDR3_26
QQNNEDPWT

SEQ ID NO: 274 - protein, 9 aa, Artificial Sequence
  VL-CDR3_27
VQGTHFPQT

SEQ ID NO: 275 - protein, 9 aa, Artificial Sequence
  VL-CDR3_28
VQYDQFPWT

SEQ ID NO: 276 - protein, 9 aa, Artificial Sequence
  VL-CDR3_29
HHSTELPYT

SEQ ID NO: 277 - protein, 8 aa, Artificial Sequence
  VL-CDR3_30
VQGTHLPT

SEQ ID NO: 278 - protein, 9 aa, Artificial Sequence
  VL-CDR3_31
QQNNEVPYT

SEQ ID NO: 279 - protein, 9 aa, Artificial Sequence
  VL-CDR3_32
QQWSSNPLT

SEQ ID NO: 280 - protein, 9 aa, Artificial Sequence
  VL-CDR3_33
QHSKEVPWT

SEQ ID NO: 281 - protein, 9 aa, Artificial Sequence
  VL-CDR3_34
QQHYSPPFT

SEQ ID NO: 282 - protein, 9 aa, Artificial Sequence
  VL-CDR3_35
QQYNSYPYT

SEQ ID NO: 283 - protein, 9 aa, Artificial Sequence
  VL-CDR3_36
WQGTHFPFT

SEQ ID NO: 284 - protein, 9 aa, Artificial Sequence
  VL-CDR3_37
QHFWSIFPT

SEQ ID NO: 285 - protein, 9 aa, Artificial Sequence
  VL-CDR3_38
QHFWSLFPT

SEQ ID NO: 286 - protein, 9 aa, Artificial Sequence
  VL-CDR3_39
QHNYISPFT

SEQ ID NO: 287 - protein, 9 aa, Artificial Sequence
  VL-CDR3_40
QQHYNTPYT

SEQ ID NO: 288 - protein, 9 aa, Artificial Sequence
  VL-CDR3_41
LQSTHFPQT

SEQ ID NO: 289 - protein, 9 aa, Artificial Sequence
  VL-CDR3_42
MQHLEYPYT

SEQ ID NO: 290 - protein, 9 aa, Artificial Sequence
  VL-CDR3_43
QQYSKLPRT

SEQ ID NO: 291 - protein, 9 aa, Artificial Sequence
  VL-CDR3_44
WQGTHFPQT

SEQ ID NO: 292 - protein, 9 aa, Artificial Sequence
  VL-CDR3_45
QQGQSSPFT

SEQ ID NO: 293 - protein, 9 aa, Artificial Sequence
  VL-CDR3_46
QQTNSWPLT

SEQ ID NO: 294 - protein, 9 aa, Artificial Sequence
  VL-CDR3_47
QHNRELPPT

SEQ ID NO: 295 - protein, 8 aa, Artificial Sequence
  VL-CDR3_48
WQGTHFPT

SEQ ID NO: 296 - protein, 9 aa, Artificial Sequence
  VL-CDR3_49
QQHYSSPWT

SEQ ID NO: 297 - protein, 116 aa, Artificial Sequence
  VH-1 Peptide Sequence
QVQLVQSGSELKKPGASVKVSCKASGYTFTNYGMNWVRQAPGQGLKWMGWINTNTGEPTYVEEFTGRFVFSLETSVSTAYLQISSLKAEDTAVYFCAPYDNFFAYWGQGTTVTVSS

SEQ ID NO: 298 - protein, 116 aa, Artificial Sequence
  VH-2 Peptide Sequence
QVQLVQSGAEVKKPGASVKVSCKASGYSFTNYYMHWVRQAPGQRLEWMGWIYPGSGNTNYNEKFQGRVTITADTSASTAYMELSSLRSEDTAVYYCSTAPGGFDVWGQGTTVTVSS

SEQ ID NO: 299 - protein, 122 aa, Artificial Sequence
  VH-3 Peptide Sequence
QVQLKQSGAELVRPGASVKLSCKASGYTFTDYYINWVKQRPGQGLEWIARIYPGTGNTDYNEKFKGRATLTAEKSSSTAYMQLSSLTSEDSAVYFCARFAYYYGSGGYFDYWGHGTTLTVSS

SEQ ID NO: 300 - protein, 119 aa, Artificial Sequence
  VH-4 Peptide Sequence
QIQLVQSGPELKKPGETVKISCKTSGYKFKTYVMSWVKQAPGKALKWMGWINTYSGVPTYADDFKGRFAFSLETSASTAYLEIINLKNEDTATYFCARDGNYGDPMDYWGQGTSVTVSS

SEQ ID NO: 301 - protein, 117 aa, Artificial Sequence
  VH-5 Peptide Sequence
QIQLVQSGPELKKPGETVKISCKASGYTFTTYGMGWVKQAPGKDLKWMGWINTYSGVPTYADDFKGRFAFSLETSASTAYLQISNLKNEDTATYFCSTPYEYDGAYWGQGTLVTVSA

SEQ ID NO: 302 - protein, 113 aa, Artificial Sequence
  VH-6 Peptide Sequence
EVQLVESGGGLVKPGGSLKLSCAASGFAFSSYAMSWVRQTPEKRLEWVATISDGGVYTYYTDHVKGRFTISRDNAEDNLYLQMSHLKSEDTAMYYCVRDGGYWGQGTTLTVSS

SEQ ID NO: 303 - protein, 116 aa, Artificial Sequence
  VH-7 Peptide Sequence
QIQLVQSGPELKKPGETVKISCKASGYTFTTYAMSWVKQAPGKGLKWMGWINTYSGVPTYADDLKGRFAFSLETSASTAYLQINNLKNEDTATYFCARGPYAMDYWGQGTSVTVSS

SEQ ID NO: 304 - protein, 115 aa, Artificial Sequence
  VH-8 Peptide Sequence
EVQLQQSGPELVKPGASVKISCKASGYTFTDFYINWVKQSHGKSLEWIGDINPKNGGINYNPKFKIKATLTVDKSSSTSYMDLRGLTSEDSAVYYCTSGYGFPYWGQGTLVTVSA

SEQ ID NO: 305 - protein, 116 aa, Artificial Sequence
  VH-9 Peptide Sequence
QIQLVQSGPELKKPGESVKISCKASGYAFTTYGMSWVQQAPGKGLKWMGWVNTYSGVPTCADDFKGRFAFSLETSASTAYLQINNLRNEDTATYFCARGPYAMDYWGQGTSVTVSS

SEQ ID NO: 306 - protein, 120 aa, Artificial Sequence
  VH-10 Peptide Sequence
QVQLQQSGPELVKPGASVKISCKASGYTFTDYYINWVKQRPGQGLEWIGWIYPGSNDTKYNEKFKGKATLTVDTSSSTAYMQLGSLTSEDSAVYFCANYFGCSGWFFDVWGTGTTVTVSS

SEQ ID NO: 307 - protein, 113 aa, Artificial Sequence
  VH-11 Peptide Sequence
EVQLVESGGGLVKPGGSLKLSCAASGFTFSSYAMSWVRQTPEKRLEWVATISDGGIYTYYPDNVKGRFTISRDNAKNNLFLQMSHLKSEDTAMYYCVRDGGYWGQGTTLTVSS

SEQ ID NO: 308 - protein, 116 aa, Artificial Sequence
  VH-12 Peptide Sequence
QIQLVQSGPELKKPGETVKISCKASGYTFTNYGMNWVKQAPGKGLKWMGWINTNTGEPTYVEEFKGRFAFSLETSASTAYLQINNLKNEDTATYFCAPYDNFFAYWGQGTLVTVSA

SEQ ID NO: 309 - protein, 116 aa, Artificial Sequence
  VH-13 Peptide Sequence
QVQLQQSGPELVKPGASVKISCKASGYSFTNYYIHWVKQRPGQGLEWIGWIYPGSGNTNYNEKFKGKATLTADTSSSTTNMQLSSLTSEDSAVYYCSTAPGGFDVWGSGTTVTVSS

SEQ ID NO: 310 - protein, 116 aa, Artificial Sequence
  VH-14 Peptide Sequence
QVQLVQSGAEVKKPGASVKVSCKASGYSFTNYYMHWVRQAPGQGLEWMGWIYPGSGNTNYNEKFQGRVTMTADTSISTAYMELSRLRSDDTAVYYCSTAPGGFDVWGQGTTVTVSS

SEQ ID NO: 311 - protein, 116 aa, Artificial Sequence
  VH-15 Peptide Sequence
QVQLVQSGAEVKKPGASVKVSCKASGYSFTNYYIHWVRQAPGQRLEWMGWIYPGSGNTNYNEKFQGRVTLTADTSASTTYMELSSLRSEDTAVYYCSTAPGGFDVWGQGTTVTVSS

SEQ ID NO: 312 - protein, 119 aa, Artificial Sequence
  VH-16 Peptide Sequence
QIQLVQSGPDLKKPGETVKISCKASGYTFTTYVMSWVKQAPGKDLKWMGWINTHSGVPTYADDFKGRFDFSLETSANTAFLQINNLKNEDTATYFCTRDGNDGDAMDNWGQGTSVTVSS

SEQ ID NO: 313 - protein, 120 aa, Artificial Sequence
  VH-17 Peptide Sequence
QVQLKQSGPGLVQPSQSLSITCTVSGFSLTSYGVHWVRQPPGKGLEWLGVIWSGGSTDYNAAFISRLSISKDNSKSQVFFKMNSLQADDTAIYYCAKGPYDYDLGWFAYWGQGTLVTVSA

SEQ ID NO: 314 - protein, 116 aa, Artificial Sequence
  VH-18 Peptide Sequence
QIQLVQSGPELKKPGETVKISCKASGYTFTTYGMSWVKQAPGKGLKWMAWINTYSGVPTYADDFKGRFAFSLETSASTAYLQINNLTNEDTATYFCARGPYAMDYWGQGTSVTVSS

SEQ ID NO: 315 - protein, 115 aa, Artificial Sequence
  VH-19 Peptide Sequence
QVQLQQPGAELVGPGSSVKLSCKASGYTFTNYWIHWVKQRPLQGLEWIGNIDPSDSETHYNQKFKDKATLTVDKSSSTAYMQLSSLTSEDSAVYYCARHGYYDYWGQGTTLTVSS

SEQ ID NO: 316 - protein, 119 aa, Artificial Sequence
  VH-20 Peptide Sequence
QVQLQQPGAELVKPGASVKLSCKASGYTFTSYWMHWVKQRPGQGLEWIGMIHPNSGSTDYNEKFKNKATLNVDKSSSTAYIQLSSLTSEDSAVYYCTRWGIYYYARDYWGQGTTLTVSS

SEQ ID NO: 317 - protein, 117 aa, Artificial Sequence
  VH-21 Peptide Sequence
QIQLVQSGPELKKPGETVKISCKASGYTFTTYGMSWVKQAPGKGLKWMGWINTYSGVPTYADDFKGRFAFSLETSASTAYLQINNLKNEDTATYFCAVPYEYDGAYWGQGTLVTVSA

SEQ ID NO: 318 - protein, 115 aa, Artificial Sequence
  VH-22 Peptide Sequence
EVQLQQSGPELVKPGASVKISCKASGYTFTDYYMNWVKQSHGKSLEWIGDINPNNGGTNYNQKFKGKATLTVDKSSSTAYMELRSLTSEDSAVYYCTSGYGFPYWGQGTLVTVSA

SEQ ID NO: 319 - protein, 117 aa, Artificial Sequence
  VH-23 Peptide Sequence
QIQLVQSGPELKKPGETVKISCKASGYTFTTYGMGWVKQAPGKGLKWMGWINTYSGVPTYADDFKGRFAFSLETSTSTAYLQINNLKNEDMATYFCATPYEYDGAYWGQGTLVTVSA

SEQ ID NO: 320 - protein, 112 aa, Artificial Sequence
  VH-24 Peptide Sequence
QVQLQQSGPELVKPGDSVKISCKAAGYTFSDYYINWVKQRPGQGLEWIGWIYPVSVNTKYNEKFKGKATLTVDTSSSTAYMQLSSLTSEDSGVYFCAYLDYWGQGTLVTVSA

SEQ ID NO: 321 - protein, 120 aa, Artificial Sequence
  VH-25 Peptide Sequence
QVQLKQSGPGLVQPSQSLSITCTVSGFSLTSYGVHWVRQAPGKGLEWLGVIWSGGSTDYNAAFMSRLSISKDNSKSQVFFKMNSLQADDTAIYYCAKSPDGYDVAWFGYWGQGTLVTVSA

SEQ ID NO: 322 - protein, 122 aa, Artificial Sequence
  VH-26 Peptide Sequence
QIQLVQSGPELKKPGETVKISCKASGYTFTNYGMNWVKQAPGKGLKWMGWINTYTGEPSYADDFKGRFAFSLETSASTAYLQINNLKNEDMATYFCARWGGYAGDYYAMDFWGQGTSVTVSS

SEQ ID NO: 323 - protein, 122 aa, Artificial Sequence
  VH-27 Peptide Sequence
QIQLVQSGPELKKPGETVKISCKASGYTFTNYGMNWVKQAPGKGLKWMGWINTYTGEPSYADDFKGRFAFSLETSASTAYLQINNLKNEDMATYFCARWGGYDGDYYAMDYWGQGTSVTVSS

SEQ ID NO: 324 - protein, 122 aa, Artificial Sequence
  VH-28 Peptide Sequence
QIQLVQSGPELKKPGETVKISCKASGYTFTNFGMNWVKQAPGKGLKWMGWINTYTGEPSYADDFKGRFAFSLETSASTAYLQINNLKNEDIATYFCARWGGYAGDYYAMDYWGQGTSVTVSS

SEQ ID NO: 325 - protein, 116 aa, Artificial Sequence
  VH-29 Peptide Sequence
EVQLLESGGGLVKPGGSLKLSCAASGFTFSSYAMSWVRQTPEKRLEWVASISSGGDTYYPDSVKGRFTISRDNARNILYLQMSSLRSEDTAMYYCASYGNSLFDYWGQGTTLTVSS

SEQ ID NO: 326 - protein, 114 aa, Artificial Sequence
  VH-30 Peptide Sequence
QIQLVQSGPELKKPGETVKISCKASGYTFTNYGMNWVKQAPGKGLKWMGWINTYTGEPTYAGDLKGRFAFSLETSASTAYLQINNLKNEDTATYFCVRYTMDYWGQGTSVTVSS

SEQ ID NO: 327 - protein, 124 aa, Artificial Sequence
  VH-31 Peptide Sequence
QVTLKESGPGILQPSQTLSLTCSFSGFSLSTSGMGVGWIRQPSGKGLEWLAHIWWDDDKYYNTALKSGLTISKDASKNQVFLKIASMDTADTATYYCARNLYDGSYGYYAMDYWGQGTSVTVSS

SEQ ID NO: 328 - protein, 122 aa, Artificial Sequence
  VH-32 Peptide Sequence
QIQLVQSGPELKKPGETVKISCKASGYTFTNYGMNWVKQAPGKGLKWMGWINTYTGEPAYADDFKGRFAFSLETSASTAYLQINNLKNEDMATYFCARWGGYDGDYYAMDYWGQGTSVTVSS

SEQ ID NO: 329 - protein, 123 aa, Artificial Sequence
  VH-33 Peptide Sequence
EVQLVESGGDLVKPGGSLKLSCAASGFTFSNYGLSWIRQTPDKRLEWVATISSGGSYTYYPDSVKGRFTISRDSAKNTLYLQMSSLKSEDTAMYYCARHAHYYGVSPYYFDYWGQGTCLTVSS

SEQ ID NO: 330 - protein, 119 aa, Artificial Sequence
  VH-34 Peptide Sequence
QIQLVQSGPEVKKPGETVKISCKASGYIFTNYGMNWVKQAPGKGLKWMGWINTYTGEPTYTDDFKGRFAFSLETSASTAYLQINNLKNEDTATYFCAKFGNYVGAMDYWGQGTSVTVSS

SEQ ID NO: 331 - protein, 120 aa, Artificial Sequence
  VH-35 Peptide Sequence
EVQLQQSGPELVKPGASVKISCKASGNTFTDHNMHWVKQSHGKSLEWIGYIYPYNGGTGYNQKFKSKATLTVDNSSSTVYMELRSLTSEDSAVYYCARGEYDYLAWFAYWGQGTLVTVSA

SEQ ID NO: 332 - protein, 119 aa, Artificial Sequence
  VH-36 Peptide Sequence
QIQLVQSGPELKKPGETVKISCKASGYTFTNYGMNWVKQAPGKGLKWMGWINTYTGEPTYVDDFKGRFAFSLETSASTAYLRINNLKNEDTATYFCAKFGNYVGAMDYWGQGTSVTVSS

SEQ ID NO: 333 - protein, 117 aa, Artificial Sequence
  VH-37 Peptide Sequence
EVQLVETGGGLVKPGGSLKLSCAASGFTFSSYAMSWVRQTPEKRLEWVASISSGGSTYYPDSVKGRFTISRDNARNILYLQMSSLRSEDTAMYYCTRFTTVVEMDYWGQGTSVTVSS

SEQ ID NO: 334 - protein, 112 aa, Artificial Sequence
  VH-38 Peptide Sequence
QVQLQQTGAELVKPGASVKLSCKASGYTFTSYWINWVKQRPGQGLEWIGNIYPGSSSIYYSEKFKSKATLTVDTSSSTAYMQLSSLTSDDSAVYYCARWGYWGQGTTLTVSS

SEQ ID NO: 335 - protein, 121 aa, Artificial Sequence
  VH-39 Peptide Sequence
QVTLKESGPGILQPSQTLSLTCSFSGFSLSTFGMGVGWIRQPSGKGLEWLAHIWWDDDKHYNPALKSRLTISKDTSKNQVFLRIANVDTADNATYYCARIDYGDYVGFAYWGQGTLVTVSA

SEQ ID NO: 336 - protein, 118 aa, Artificial Sequence
  VH-40 Peptide Sequence
QVQLQQSGPELVRPGALVKISCKASGYTFTSYDINWVKQRPGQGLEWIGWIYPGDGSTKYNEKFKGKATLTADKSSSTAYMQLSSLTSENSAVYFCAREAASNAMDYWGQGTSVTVSS

SEQ ID NO: 337 - protein, 122 aa, Artificial Sequence
  VH-41 Peptide Sequence
EVKLEESGGGLVQPGGSMKLSCVASGFTFSNYWMNWVRQSPEKGLEWVAEIRLKSNNYATHYAESVKGRFTISRDDSKSSVYLQMNNLRAEDTGIYYCTRHYGFPYWYFDVWGAGTTVTVSS

SEQ ID NO: 338 - protein, 118 aa, Artificial Sequence
  VH-42 Peptide Sequence
QIQLVQSGPELKKPGETVKISCKASGYTFTNYGMNWVKQAPGKGLKWMGWINTNTGEPTYAEEFKGRFAFSLETSASTAYLQINNLKNEDTATYFCATGGGNWDFDYWGQGTTLTVSS

SEQ ID NO: 339 - protein, 114 aa, Artificial Sequence
  VH-43 Peptide Sequence
QIQLVQSGPELTKPGETVKISCKASGYTFTDYGMNWVRQAPGETLKWMGWINTYTGEPTYADDFKGRFAFSLESSASTAYLQINNLKNEDVATYFCARYPMDYWGQGTSVTVSS

SEQ ID NO: 340 - protein, 122 aa, Artificial Sequence
  VH-44 Peptide Sequence
EVKLEESGGGLVQPGGSMKLSCVASGFTFSNYWMNWVRQSPEKGLEWVAELRLKSNNYATHYAESVKGRFTISRDDSKSSVYLQMNNLRAEDTGIYYCTRHYGFPYWYFDVWGAGTTVTVSS

SEQ ID NO: 341 - protein, 118 aa, Artificial Sequence
  VH-45 Peptide Sequence
EVQLQQSGPELVKPGASVKMSCKASGYTFTSYVMHWVKQKPGQGLEWIGYINPYNDGTKYNEKFKGKATLTSDKSSSTAYMELSSLTSEDSAVYYCARLLFYYAMDYWGQGTSVTVSS

SEQ ID NO: 342 - protein, 118 aa, Artificial Sequence
  VH-46 Peptide Sequence
QVQLQQSGPELVRPGALVKISCKASGYTFTSYDINWVKQRPGQGLEWIGWIYPGDGSTKYNEKFKGKATLTADKSSSTVYMQLSSLTSENSAVYFCAREAASNAMDYWGQGTSVTVSS

SEQ ID NO: 343 - protein, 118 aa, Artificial Sequence
  VH-47 Peptide Sequence
QVQLQQSGPELVKPGALVKISCKASGYTFTSYDINWVKQRPGQGLEWIGWIYPGDGSTKYNEKFKGKAALTADKSSSTAYMQLSSLTSENSAVYFCAREAASNAMDYWGQGTSVTVSS

SEQ ID NO: 344 - protein, 118 aa, Artificial Sequence
  VH-48 Peptide Sequence
EVQLQQSGPELVKPGASVKMSCKASGYSFTNYIMHWVKQKPGQGLEWIGYINPYNDGTKYNEKFKGKATLTSDKSSSTAYMELSSLTSEDSAVYYCARLLFYYAMDYWGQGTSVTVSS

SEQ ID NO: 345 - protein, 118 aa, Artificial Sequence
  VH-49 Peptide Sequence
QVQLQQSGAELVKPGASVKLSCKASGYTFRSYDINWVRQRPEQGLEWIGWIFPGEGISKYNEKFKGKATLTTDKLSSTAYMQLSSLTSEDSAVYFCAREATAGAMDYWGQGTSVTVSS

SEQ ID NO: 346 - protein, 122 aa, Artificial Sequence
  VH-50 Peptide Sequence
EVKLLESGGGLVQPGGSMKLSCVASGFTFSNFWMNWVRQSPEKGLEWVAEIRLKSNNYATHYAESVKGRFTISRDDSKSSVYLQMNNLRAEDTGIYYCTRHYGFPYWYFDVWGAGTTVTVSS

SEQ ID NO: 347 - protein, 118 aa, Artificial Sequence
  VH-51 Peptide Sequence
QIQLQQSGAELVKPGASVKLSCKASGYTFTSYDICWVRQRPEQGLEWIGWIFPGDGTTKYTENFKGKATLTTDKSSSTAYMHLSRLTSEDSAVYFCAREGAGSWFAYWGQGTLVTVSA

SEQ ID NO: 348 - protein, 114 aa, Artificial Sequence
  VH-52 Peptide Sequence
EVQLQQSGAELVRPGTSVKVSCKASEYAFNNYMMEWVKQRPGQGLEWIGVINPGSGATNYNENFKDKATLTADKSSTTAYMQLSSLTSDDSAVYFCTYNDLGYWGQGTLVTVSA

SEQ ID NO: 349 - protein, 123 aa, Artificial Sequence
  VH-53 Peptide Sequence
EVKLQQSGPELMKPGTSMKISCKASGYSFTGYTMNWVKQSHGKNLEWIGLINPYNGGTNYNQKFRGKATLSVDKSSNTAYMELLSLTSEDSAVYYCARKDDYYGSSPYALDYWGQGTSVTVSS

SEQ ID NO: 350 - protein, 116 aa, Artificial Sequence
  VH-54 Peptide Sequence
QVQLQQSGAELMKPGASVKISCKATGYTFTNYWIEWVKQRPGHGLEWIGEFLPGDGSSHYNEKFKGKATFTSDTSSNTAYIHLTSLTSEDSAVYYCVRDDYDSDYWAQGTTLTVSS

SEQ ID NO: 351 - protein, 120 aa, Artificial Sequence
  VH-55 Peptide Sequence
QVQMKQSGPGLVQPSQSLSITCTVSGFSLINYGVHWVRQSPGKGLEWLGVIWSGGSTDYNAAFISRLSISKDNSKSQVFFKMNSLQADDTAIYYCARIYYYGRGYAMDYWGQGTSVTVSS

SEQ ID NO: 352 - protein, 122 aa, Artificial Sequence
  VH-56 Peptide Sequence
EVQLQQSGAEVVKPGAPVKLSCKASGYTFNNYWLNWVKQRPGRGLEWIGRIDPSDSETHYNQKFKDKATLTVDMSSSTAYIQLSSLTSEDSAVYYCARGDYYYGTRGPMDYWGQGTSVTVSS

SEQ ID NO: 353 - protein, 115 aa, Artificial Sequence
  VH-57 Peptide Sequence
QVQLQQSGAELVRPGASVNLSCKASGYTFTNYWMNWVKQRPGQGLEWVGMIDPSDSETHYNQMFKDKATLTIDKSSSIAYMQLSSLTSEDSAVYYCARWGAMDYWGQGTSVTVSS

SEQ ID NO: 354 - protein, 121 aa, Artificial Sequence
  VH-58 Peptide Sequence
QVQLKQSGPGLVAPSQSLSITCTVSGFSLTSYGVHWVRQPPGKGLEWLGIIWAGGSTNYNPALMSRLSISKDKSKSQVFLKMNSLKTDDTAMYYCARDRASLLRPGAMDYWGQGTSVTVSS

SEQ ID NO: 355 - protein, 118 aa, Artificial Sequence
  VH-59 Peptide Sequence
QIQLVQSGPELKKPGETVKISCKASGYTFTNYGMNWVKQAPGKGLKWMGWINTNTGEPTYAEEFKGRFAFSLETSASTAYLQINYLKNEDTATFFCARLDYDYDEDYWGQGTTLTVSS

SEQ ID NO: 356 - protein, 120 aa, Artificial Sequence
  VH-60 Peptide Sequence
QVQLVETGPGLVAPSQSLSITCTVSGFSLTSYGVHWIRQSPGKGLEWLGTIWAGGSTDYNSPLMSRLSISKDNSKNQVFLKMNSLQIDDTAIYYCASPPSGYDYDVFASWGQGTLVTVSA

SEQ ID NO: 357 - protein, 120 aa, Artificial Sequence
  VH-61 Peptide Sequence
QVQLKQSGPGLVQPSQSLSITCTVSGFSLINYGVHWVRQSPGKGLEWLGVIWSGGSTDYNAAFISRLSISKDNSKSQVFFKMNSLQADDTAIYYCARIYYYGRGYAMDYWGQGTSVTVSS

SEQ ID NO: 358 - protein, 120 aa, Artificial Sequence
  VH-62 Peptide Sequence
QVQLKESGPGLVAPSQSLSITCTVSGFSLTSYGVHWIRQPPGKGLEWLGGIWAGGSTDYNSPLMSRLSITKDNSKSQVFLKMNSLQSDDTAMYYCASPPSGYDYDVFAYWGQGTLVTVSA

SEQ ID NO: 359 - protein, 120 aa, Artificial Sequence
  VH-63 Peptide Sequence
QVQLKESGPVLVAPSQSLSITCTVSGFSLSSYGVHWVRQPPGKGLEWLGVIWAGGSTDYDSALMSRLSISKDNSKSQVFLKMDSLQTDDTAMYYCAKPPYDYDGAWFAYWGQGTLVTVSA

SEQ ID NO: 360 - protein, 114 aa, Artificial Sequence
  VH-64 Peptide Sequence
QVQLQQSGPQLVRPGASVKISCKASGYSFTNYWMHWVKQRPGQGLEWIGMIDPSDSETRLNQKFKDKATLTVDKSSSTAYMQLSSPTSEDSAVYYCATGRPDYWGQGTTLTVSS

SEQ ID NO: 361 - protein, 114 aa, Artificial Sequence
  VH-65 Peptide Sequence
QVQLQQSGPQLVRPGASVKISCKASGYSFTSYWMHWVKQRPGQGLEWIGMIDPSDSETRLNQKFKDKATLTVDKSSSTAYMQLSSPTSEDSIVYYCAKGRPDYWGQGTTLTVSS

SEQ ID NO: 362 - protein, 118 aa, Artificial Sequence
  VH-66 Peptide Sequence
DGKLQESGPGLVKPSQSLSLTCSVTGYSITSGYYWNWIRQFPGNKLEWMGHISYDGRNNYNPSLKNRISITRDTSKNQFFLKLNSVTTEDTATYYCAGYDFLWYFDVWGTGTTVTVSS

SEQ ID NO: 363 - protein, 121 aa, Artificial Sequence
  VH-67 Peptide Sequence
QVQLKESGPGILQPSQTLSLTCSFSGFSLSTFGMGVGWIRQPSGKGLEWLAHIWWDDDKHYNPALKSRLTISKDTSKNQVFLRIANVDTADNATYYCARIDYGDYVGFAYWGQGTLVTVSA

SEQ ID NO: 364 - protein, 118 aa, Artificial Sequence
  VH-68 Peptide Sequence
DGQLQESGPGLVKPSQSLSLTCSVTGYSITSGYYWNWIRQFPGNKLEWMGHISYDGRNNYNPSLKNRISITRDTSKNQFFLKLNSVTTEDTATYYCAGYDFLWYFDVWGTGTTVTVSS

SEQ ID NO: 365 - protein, 119 aa, Artificial Sequence
  VH-69 Peptide Sequence
EVQLQQSGAELVKSGASVKLSCTASGFNIKDYYMHWVKQRTEQGLEWIGRIYPEDDETKYAPKFQGKATITADTSSNTAYLQLSSLTSEDTAVYYCARSGGYYVWFAYWGQGTLVTVSA

SEQ ID NO: 366 - protein, 121 aa, Artificial Sequence
  VH-70 Peptide Sequence
EVQLQQSGPELVKPGSSVKISCKASRYTFTDYNMDWVKQSHGKRLEWIGYIYPNNGGTGYNQKFKGKATLTVDKSSSTAYMELRSLTSEDSAVYYCARSYYDGSYDAMDYWGQGTSVTVSS

SEQ ID NO: 367 - protein, 114 aa, Artificial Sequence
  VH-71 Peptide Sequence
QIQLVQSGPELKKPGETVKISCKASGYTFTIFGMNWVKQAPGKGLKWMGWVNTYTGEPTYADDFKGRFAFSLETSASTAYLQINNLKNEDTATYFCARGWFAYWGQGTLVTVSA

SEQ ID NO: 368 - protein, 120 aa, Artificial Sequence
  VH-72 Peptide Sequence
QVQLKESGPVLVAPSQSLSITCTVSGFSLTSYGIHWVRQPPGKGLEWLGVIWAGGSTNYNSALMSRLSISKDNSKSQVFLKMNSLQIDDTAMYYCAKPPHDYDQAWFAYWGQGTLITVSA

SEQ ID NO: 369 - protein, 116 aa, Artificial Sequence
  VH-73 Peptide Sequence
QVQLQQSGAELVRPGASVKLSCKASGYTFTSSWMNWVKQRPGQGLDWIGMIDPSDSETHYNQMFKDKATLTVDKSSNTAYMQLSRLTSEDSAVYYCVNSNYESGYWGQGTTLTVSS

SEQ ID NO: 370 - protein, 116 aa, Artificial Sequence
  VH-74 Peptide Sequence
QVQLQQSGAELVRPGASVKLSCKASGYTFTGYWLNWVKQRPGQGLEWIGMIDPSDSETHYNQVFKDKATMTVDRSSSTAYMQLSGLTSEDSAVYYCANSNYASGSWGQGTTLTVSS

SEQ ID NO: 371 - protein, 120 aa, Artificial Sequence
  VH-75 Peptide Sequence
EVQLQQSGPELVKPGASVKVSCKASGYSFTDYNMYWVMQSHGKSLEWIGYIDPYNDATSYSQKFTGKATLTVDKSSSTAFMHLNSLTSEDSAVYYCARWGRYEYYAMDYWGQGTSVTVSS

SEQ ID NO: 372 - protein, 115 aa, Artificial Sequence
  VH-76 Peptide Sequence
QVQLKESGPDLVQPSQTLSLTCTVSGFSLTIYGVHWVRQPPGKGLEWVGTVAWDDKKYYNSPLQSRLSISRDTSKNQVFLKLSSLQTEDTAMYYCTMTGGPINYWGPGTSVTVSS

SEQ ID NO: 373 - protein, 117 aa, Artificial Sequence
  VH-77 Peptide Sequence
EVQLVESGGGLVKPGGSLKLSCAASGFTFSSYAMSWVRQTPEKRLEWVASISSGDSPYYPDSVKGRFTISRDNARNILYLQMSSLRSEDTAMYYCTRFTTVVEMDYWGQGTSVTVSS

SEQ ID NO: 374 - protein, 112 aa, Artificial Sequence
  VL-1 Peptide Sequence
DIVLTQSPLSLPVTPGEPASISCRSSKSLLYKDGKTYLNWFLQKPGQSPQLLIYLMSTHASGVPDRFSGSGSGTDFTLKISRVEAEDVGVYYCQQLVDYPLTFGGGTKLEIK

SEQ ID NO: 375 - protein, 112 aa, Artificial Sequence
  VL-2 Peptide Sequence
DIVMTQTPLSLSVTPGQPASISCKSSKSLLHSDGITYLYWYLQKPGQSPQLLIYRMSNLASGVPDRFSGSGSGTDFTLKISRVEAEDVGVYYCAQMLEFPLTFGQGTKLEIK

SEQ ID NO: 376 - protein, 107 aa, Artificial Sequence
  VL-3 Peptide Sequence
DILMTQSPSSMSVSLGDTVSITCHASQGINSNMGWLQQKPGKSFKGLIYHATNLEDGVPSRFSGSGSGADYSLTISSLESEDFADYYCVQYAQFPPTFGSGTKLEIK

SEQ ID NO: 377 - protein, 112 aa, Artificial Sequence
  VL-4 Peptide Sequence
DVVMTQTPLTLSVAIGQPASISCKSSQSLLYTNGKTYLNWLLQRPGQSPKRLIYLLSKLDSGVPDRFSASGSGTDFTLKISRVEAEDLGVYYCLQSTHFPLTFGAGTKLEMK

SEQ ID NO: 378 - protein, 112 aa, Artificial Sequence
  VL-5 Peptide Sequence
DVVMTQTPLTLSVTIGQPASISCKSSQSLFDSDGKTYLNWLLQRPGQSPKRLIYLVSKLDSGVPDRFTGSGSGTDFTLKISRVEAEDLGVYYCWQGTHFPLTFGAGTKLEMK

SEQ ID NO: 379 - protein, 112 aa, Artificial Sequence
  VL-6 Peptide Sequence
DVLMTQTPLSLPVSLGDQASISCRSSQSIVHNNGNTYLEWYLQKPGQSPKLLIYKVSNRFSGVPDRFSGSGSGTDFTLKISRVEAEDLGVYYCFQGSHVPLTFGGGTKLELK

SEQ ID NO: 380 - protein, 107 aa, Artificial Sequence
  VL-7 Peptide Sequence
DIQMTQTTSSLSASLGDRVTISCSASQGINNYLNWYQQKPDGTVKLLIYYASSLHSGVPSRFSGSGSGTDYSLTISNLEPEDIATYYCQQYSQVPYTFGSGTKLEIK

SEQ ID NO: 381 - protein, 107 aa, Artificial Sequence
  VL-8 Peptide Sequence
DIQMNQSPSSLSASLGDTITITCRASQNIYIWLSWYQQKPGNIPKLLIYKASNLHTGVPSRFSGSGSGTDFTLTISTLQPEDIATYFCLQGQSYPLTFGAGTKLEMK

SEQ ID NO: 382 - protein, 107 aa, Artificial Sequence
  VL-9 Peptide Sequence
DIQMTQTTSSLSASLGDRVTINCSASQDISNYLNWYQQKPDGTVKLLIYYTSSLLSGVPSRFSGSGSGTDYSLTISNLEPEDIATYFCQQYSKLPYTFGSGTHLEIK

SEQ ID NO: 383 - protein, 112 aa, Artificial Sequence
  VL-10 Peptide Sequence
DIVMTQAAFSNPVTLGTSASISCRSSKSLLHSDGITYLYWYLQRPGQSPQLLIYRMSNLASGVPDRFSGSGSGTDFTLRISRVEAEDVGVYYCAQMIEFPLTFGAGTILELK

SEQ ID NO: 384 - protein, 112 aa, Artificial Sequence
  VL-11 Peptide Sequence
DVVMTQTPLTLSVAIGQPASISCKSSQSLLYTNGKTYLNWLLQRPGQSPKRLIYLVSKLDSGVPDRFSGSGSGTDFTLKISRVEAEDLGVYYCLQSTHFPLTFGAGTKLELK

SEQ ID NO: 385 - protein, 112 aa, Artificial Sequence
  VL-12 Peptide Sequence
DVLMTQTPLSLPVSLGDQASISCRSSQSIVHSNGNTYLEWYLQKPGQSPKLLIYKVSNRFSGVPDRFSGSGSGTDFTLKISRVEAEDLGVYYCFQGSHVPLTFGAGTKLELK

SEQ ID NO: 386 - protein, 112 aa, Artificial Sequence
  VL-13 Peptide Sequence
DIVITQDELSNPVTSGESVSISCRSSKSLLYKDGKTYLNWFLQRPGQSPQLLIYLMSTHASGVSDRFSGSGSGTDFTLEISRVKAEDVGVYYCQQLVDYPLTFGAGTKLELK

SEQ ID NO: 387 - protein, 112 aa, Artificial Sequence
  VL-14 Peptide Sequence
DIVMTQAAFSNPVTLGTSASISCRSSKSLLHSDGITYLYWYLQRPGQSPQLLIYRMSNLASGVPDRFSGSGSGTDFTLRISRVEAEDVGVYYCAQMLEFPLTFGAGTKLELK

SEQ ID NO: 388 - protein, 112 aa, Artificial Sequence
  VL-15 Peptide Sequence
DIVMTQSPLSLPVTPGEPASISCRSSKSLLHSDGITYLYWYLQKPGQSPQLLIYRMSNLASGVPDRFSGSGSGTDFTLKISRVEAEDVGVYYCAQMLEFPLTFGQGTKLEIK

SEQ ID NO: 389 - protein, 113 aa, Artificial Sequence
  VL-16 Peptide Sequence
DVVMTQTPLTLSVTIGQPASISCKSSQSLLYTDGKTYLSWFLQRPGQSPKRLIYLVSKLDSGVPDRFSGSGSGTDFTLKISRVEAEDLGVYYCLQSTHFPLTFGAGTKLEVKR

SEQ ID NO: 390 - protein, 108 aa, Artificial Sequence
  VL-17 Peptide Sequence
SIVMTQTPKFLLVSAGDRVTITCKASQSVSNDVAWYQQKPGQSPKLLIYYASNRYTGVPDRFTGSGYGTDFTFTISTVQAEDLAVYFCQQDYTSPYTFGGGTKLEIKR

SEQ ID NO: 391 - protein, 108 aa, Artificial Sequence
  VL-18 Peptide Sequence
DIQMTQTTSSLSASLGDRVTISCSASQGISNYLNWYQQKPDGTVKLLIYYTSSLHSGVPSRFSGSGSGTDYSLTISNLEPEDIATYYCQQYSELPYTFGSGTKLEIKR

SEQ ID NO: 392 - protein, 108 aa, Artificial Sequence
  VL-19 Peptide Sequence
DIVMTQSHKFMSTSVGDRVSITCKASQDVSTAVAWYQQKPGQSPKLLIYWASTRHTGVPDRFTGSGSGTDYTLTISSVQAEDLALYYCQQHYTTPLTFGAGTKLELKR

SEQ ID NO: 393 - protein, 108 aa, Artificial Sequence
  VL-20 Peptide Sequence
DIVMTQSQKFMSTSVGERVSITCKASQNVGTNVAWYQQKAGQSLELLIYGASNRHTGVPDRFTGSGSGTDFTLTITNVQSEDMTNYFCEQYSNFPLTFGAGTKLELKR

SEQ ID NO: 394 - protein, 113 aa, Artificial Sequence
  VL-21 Peptide Sequence
DVVMTQTPLTLSVTIGQPASISCKSSQSLFHSDGKTYLNWLLQRPGQSPKRLIYLVSKLDSGVPDRFTGSGSGTDFTPKISRVEDEDLGVYYCWQGTHFPLTFGAGTKLEMKR

SEQ ID NO: 395 - protein, 108 aa, Artificial Sequence
  VL-22 Peptide Sequence
DIQMNQSPSSLSASLGDTISITCRASQNINIWLSWYQQKPGNIPQLLIYKASNLHTGVPSRFSGSGSGTDFTLTISSLQPEDIATYYCLQGQSYPLTFGAGTKLVMKR

SEQ ID NO: 396 - protein, 111 aa, Artificial Sequence
  VL-23 Peptide Sequence
DVVMTQTPLTLSVTIGQPASISCKSSQSLLHSDGKTYLNWLLQRPGQPPKRLMYLVSTLDSGVPDRFTGSGSGTDFTLKISRVEAEDLGVYYCWQGTHFPLTFGAGTKPER

SEQ ID NO: 397 - protein, 111 aa, Artificial Sequence
  VL-24 Peptide Sequence
DIVMTQAAFSNPVTLGTSASISCRSSKSLLHSDGITYFYWYLQRPGQSPQLLIYRMSNLASGVPDRFSGSGSGTDFTLRISRVEAEDVGVYYCAQMLEFPLTFGAGTKLER

SEQ ID NO: 398 - protein, 108 aa, Artificial Sequence
  VL-25 Peptide Sequence
DIVMTQSHKFMSTSVGDRVSITCKASQDVRTAVAWYQQKPGQSPKLLIYWASTRHTGVPDRFTGSGSGTDFTLTLSNVQSEDLADYFCQQYSSYPWTFGGGTKLEIKR

SEQ ID NO: 399 - protein, 112 aa, Artificial Sequence
  VL-26 Peptide Sequence
NIWLTQSPSSLAVSAGEMVTMTCKSSQSVLYSSNQKNYLAWYQQKPGQSPKLLIYWASTRESGVPDRFTGSGSGTDFSLTISSVQAEDLAVYYCHQYLSSLTFGAGTKLELK

SEQ ID NO: 400 - protein, 112 aa, Artificial Sequence
  VL-27 Peptide Sequence
NIMMTQSPSSLAVSAGEKVTMSCKSSQSVLYSSNQKNYLAWYQQKPGQSPKLLIYWASTRESGVPDRFTGSGSGTDFTLTISSVQPEDLAVYYCHQYLSSLTFGAGTKLELK

SEQ ID NO: 401 - protein, 112 aa, Artificial Sequence
  VL-28 Peptide Sequence
NIMMTQSPSSLAVSAGQKVTMSCKSSQSVLYSSSQKNYLAWYQQKPGQSPKLLIYWASTRESGVPDRFSGSGSGTDFTLTISSVQPEDLAVYYCHQYLSSLTFGAGTKLELK

SEQ ID NO: 402 - protein, 112 aa, Artificial Sequence
  VL-29 Peptide Sequence
DVVMTQTPLSLPVSLGDQASISCRSSQSLVHNSGNTYLHWYLQRPGQSPNLLIYKVSNRFSGVPDRFSGSGSGTDFTLKISRVAAEDLGVYFCSQSTHVPPTFGGGTKLEIK

SEQ ID NO: 403 - protein, 109 aa, Artificial Sequence
  VL-30 Peptide Sequence
QAVVTQESALTTSPGETVTLTCRSSTGAVTTSNYANWVQEKPDHLFTGLIGGINNRVPGVPARFSGSLIGDKAALTITGAQTEDEAIYFCALWYSNHWVFGGGTKLTVL

SEQ ID NO: 404 - protein, 112 aa, Artificial Sequence
  VL-31 Peptide Sequence
DIVMTQAAFSNPVTLGTSASISCRSSKSLLHTNGITFLYWYLQKPGQSPQPLIYQMSNLASGVPDRFSSSGSGTDFTLRISRVEAEDVGVYYCAQNLELPWTFGGGTKLEIN

SEQ ID NO: 405 - protein, 112 aa, Artificial Sequence
  VL-32 Peptide Sequence
NIMMTQSPSSLAVSAGEKVTMSCKSSQSVLYSSNQKNYLAWYQQKPGQSPKLLIYWASTRESGVPDRFTGSGSGTDFTLTISSVQAEDLAVYYCHQYLSSLTFGAGTKLELK

SEQ ID NO: 406 - protein, 113 aa, Artificial Sequence
  VL-33 Peptide Sequence
DIVMTQSPSSLAMSVGQKVTMSCKSSQSLLNSSNQKNYLAWYQQKPGQSPKLLVYFASTRESGVPDRFIGSGSGTDFTLTISSVQAEDLADYFCQQHYSTPYTFGGGAKLEIK

SEQ ID NO: 407 - protein, 107 aa, Artificial Sequence
  VL-34 Peptide Sequence
DIRMTQSPSSLSASLGDTITITCHASQNINVWLSWYQQKPGNIPKLLIYKASNLHTGVPSRFSGSGSGTGFTLTISSLQPEDIATYYCQQGQSYPYTFGGGTKLELK

SEQ ID NO: 408 - protein, 107 aa, Artificial Sequence
  VL-35 Peptide Sequence
EIVLTQSPASLSVTTGEKVTIRCITSIDIDDDMNWYQQKPGEPPKLLISEGNTLRPGVPSRFSSSGYGTDFVFTIENTLSEDVADYYCLQSDNKPLTFGAGTKLELK

SEQ ID NO: 409 - protein, 107 aa, Artificial Sequence
  VL-36 Peptide Sequence
DIQVIQSPSSLSASLGDTITITCHASQNINVWLSWYQQKPGNIPKLLIYKASNLHTGVPSRFSGSGSGTGFTLTISSLQPEDIATYYCQQGQSYPYTFGGGTKLELK

SEQ ID NO: 410 - protein, 107 aa, Artificial Sequence
  VL-37 Peptide Sequence
EIKMNQSPSSLSASLGDTITITCHASQNINVWLSWYQQKPGNIPKLLIYKASNLHTGVPSRFSGSGSGTGFTLTISSLQPEDIATYYCQQGQSYPYTFGGGTKLELK

SEQ ID NO: 411 - protein, 109 aa, Artificial Sequence
  VL-38 Peptide Sequence
QAVVTQESALTTSPGETVTLTCRSSTGAVTTSNYANWVQEKPDHLFTGLIGGTNNRAPGVPARFSGSLIGDKAALTITGAQTEDEAIYFCALWYSNHLVFGGGTKLTVL

SEQ ID NO: 412 - protein, 112 aa, Artificial Sequence
  VL-39 Peptide Sequence
DVLMTQTPLSLPVSLGDQASISCRSSQDIVHSSGNTYLEWYLQKPGQSLKLLIYKVSNRFSGVPDRFSASGSGTDFTLKISRVEAEDLGVYYCFQGSHVPPTFGSGTKLEIK

SEQ ID NO: 413 - protein, 112 aa, Artificial Sequence
  VL-40 Peptide Sequence
DIGMRQAAFSNPVTLGTSASISCRSSKSLLYSNGITYLYWFLQKPGQSPQLLIYQMSNLASGVPDRFSSSGSGTDFTLRISRVEADDVGVYYCAQNLELPWTFGGGTKLEIK

SEQ ID NO: 414 - protein, 111 aa, Artificial Sequence
  VL-41 Peptide Sequence
DIVLTQSPASLGVSLGQRATISCRASKSVSTSGYSYMHWYQQKPGQPPKLLIYLASILESGVPARFSGSGSGTDFTLNIHPVEEEDAAIYYCQHSRELPLTFGAGTKLELK

SEQ ID NO: 415 - protein, 111 aa, Artificial Sequence
  VL-42 Peptide Sequence
NIVLTQSPASLAVSLGQRATISCRASESVDSYGNSFMHWYQQKPGQPPKLLIYLASNLESGVPARFSGSGSRTDFTLTIDPVEADDAATYYCQQNNEDPWTFGGGTKLEIK

SEQ ID NO: 416 - protein, 112 aa, Artificial Sequence
  VL-43 Peptide Sequence
DVVMTQTPLTLSVTIGQPASISCKSSQSLLYSNGKTYLNWLLQRPGQSPKRLIYLVSKLDSGVPDRFTGSGSGTDFTLKISRVEAEDLGVYYCVQGTHFPQTFGGGTKLEIK

SEQ ID NO: 417 - protein, 107 aa, Artificial Sequence
  VL-44 Peptide Sequence
DILMTQSPSSMSVSLGDTVSITCHASQGINSNIGWLQQKPGKSFKGLIYHGTNLEDGVPSRFSGSGSGADYSLTISSLESEDFADYYCVQYDQFPWTFGGGTKLEIK

SEQ ID NO: 418 - protein, 111 aa, Artificial Sequence
  VL-45 Peptide Sequence
DIVMSQSPASLGVSLGQRATISCRASKSVSTSGYSYMHWYQQKPGQPPKLLIYLASILESGVPARFSGSGSGTDFTLNIHPVEEEDAAIYYCQHSRELPLTFGAGTKLELK

SEQ ID NO: 419 - protein, 111 aa, Artificial Sequence
  VL-46 Peptide Sequence
DIVLTQSPASLAVSLGQRATISCRASKSVSTSGYSYMHWYQQKPGQPPKLLIYLASILESGVPARFSGSGSGTDFTLNIHPVEEEDAATYYCQHSRELPLTFGAGTKLELK

SEQ ID NO: 420 - protein, 107 aa, Artificial Sequence
  VL-47 Peptide Sequence
DILMTQTPSSMSVSLGDTVSITCHASQGISSNIGWLQQKPRKSFKGLIYYGTNLEDGVPSRFSGSGSGADYSLTISSLESEDFADYYCVQYDQFPWTFGGGTKLEIK

SEQ ID NO: 421 - protein, 111 aa, Artificial Sequence
  VL-48 Peptide Sequence
DIVLTQSPASLAVSLGQRATISCRASKSVSTSGYSCMHWYQQKPGQPPKLLIYLASNLESGVPARFSGGGSGTDFTLSIHPVEEEDAATYYCHHSTELPYTFGGGTKLEVE

SEQ ID NO: 422 - protein, 111 aa, Artificial Sequence
  VL-49 Peptide Sequence
DIVLTQSPASLAVSLGQRATISCRASESVDSYGNSFMHWYQQKPGQPPKLLIYLASNLESGVPARFSGSGSRTDFTLTIDPVEADDAATYYCQQNNEDPWTFGGGTKLEIK

SEQ ID NO: 423 - protein, 111 aa, Artificial Sequence
  VL-50 Peptide Sequence
DVVMTQTPLTLSVTIGQPASISCKSSQSLLYSDGKTYLNWLLQRPGQSPKRLIYLVSQLDSGVPDRFTGSGSGTDFTLKISRVEADDLGVYCCVQGTHLPTFGGGTKLEIK

SEQ ID NO: 424 - protein, 111 aa, Artificial Sequence
  VL-51 Peptide Sequence
DIVMTQSPASLAVSLGQRATISCRASESVENHVNSFMHWFQQKPGQPPKLLIYRASNLQSGIPARFSGSGSRTDFTLTINPVEADDVATYYCQQNNEVPYTFGGGTKLEIK

SEQ ID NO: 425 - protein, 106 aa, Artificial Sequence
  VL-52 Peptide Sequence
QIVLSQSPAILSASPGEKVTMTCRASSSVTYMYWYQQKPGSSPQPWIYATSNLASGVPARFSGSGSGTSYSLTISRVEAEDAATYYCQQWSSNPLTFGAGTKLELK

SEQ ID NO: 426 - protein, 111 aa, Artificial Sequence
  VL-53 Peptide Sequence
DIVLTQSPASLAVSLGQRATISCRASESLDNSGISFMNWFQQRPGQPPKLLIYAASNLESGVPARFSGSGSGTDFSLNIHPMEEDDAAMYFCQHSKEVPWTFGGGTKLEIK

SEQ ID NO: 427 - protein, 107 aa, Artificial Sequence
  VL-54 Peptide Sequence
DIVMTQSHKIMSTSVGDRVSITCKASQDVSTTVAWFQQKPGQSPKLLLYWASTRHTGVPDRFTGSGSGTDYTLTISSVQAEDLALYYCQQHYSPPFTFGSGTKLEIK

SEQ ID NO: 428 - protein, 107 aa, Artificial Sequence
  VL-55 Peptide Sequence
DIVMTQSQKFMSTSVGDRVSVTCKASQNVGINVAWYQQKPGQSPKALIYSASYRYSGVPDRFTGSGSGTDFTLTISNVQSEDLAEYFCQQYNSYPYTFGGGTKLEMK

SEQ ID NO: 429 - protein, 112 aa, Artificial Sequence
  VL-56 Peptide Sequence
DVVMTQTPLTLSVTLGQPASISCRSSQSLLDSDGKTYLNWLLQRPGQSPKRLIYLVSRLDSGVPDRFTGSGSGTDFTLKISRVEAEDLGVYYCWQGTHFPFTFGGGTKLEIK

SEQ ID NO: 430 - protein, 107 aa, Artificial Sequence
  VL-57 Peptide Sequence
DIRMTQSPASLSASVGETVTITCRASGNIHNYLAWYHQKQGKSPQLLVYNVKTLADGVPSRFSGSGSGTQFSLKINSLQPEDFGTYYCQHFWSIFPTFGGGTKLEIK

SEQ ID NO: 431 - protein, 106 aa, Artificial Sequence
  VL-58 Peptide Sequence
QILLSQSPAILSASPGEKVTMTCRASSSVTYMYWYQQKPGSSPQPWIYATSNLASGVPARFSGSGSGTSYSLTISRVEAEDAATYYCQQWSSNPLTFGAGTKLELK

SEQ ID NO: 432 - protein, 107 aa, Artificial Sequence
  VL-59 Peptide Sequence
DILMTQSPASLSASVGETVTITCRASGNIHNYLAWYQQKQGKSPQLLVYSAKTLADGVPSRFSGSGSGTQFSLKIDSLQPEDFGTYYCQHFWSLFPTFGGGTKLEIK

SEQ ID NO: 433 - protein, 107 aa, Artificial Sequence
  VL-60 Peptide Sequence
DVVMTQTPKFLLVSAGDRVTITCKASQSVSSDVAWYQQKPGQSPKLLIYFASNRYTGVPDRFTGSGYGTDFTFTISTVQAEDLAVYFCQHNYISPFTFGGGTKLEIK

SEQ ID NO: 434 - protein, 107 aa, Artificial Sequence
  VL-61 Peptide Sequence
DIVMTQSHKFMSTSVGDRVSITCKASQDVSTAVAWYQQKPGQSPKLLIYWASTRHTGVPDRFTGSGSGTDYTLTISSVQAEDLALYYCQQHYSTPYTFGGGTKLEIK

SEQ ID NO: 435 - protein, 107 aa, Artificial Sequence
  VL-62 Peptide Sequence
DIAMTQSHKFMSTSVGDRVSITCKASQDVSTAVAWYQQKPGQSPKLLIYWASTRHTGVPDRFTGSGSGTDYTLTISSVQAEDLALYYCQQHYNTPYTFGGGTKLEIK

SEQ ID NO: 436 - protein, 112 aa, Artificial Sequence
  VL-63 Peptide Sequence
DVGMTQTPLILSVTIGQPASISCKSSQSLLYINGKTYLNWLLQRPGQSPKRLIYLVSKLDSGVPNRFSGSGSGTDFTLKISRVEAEDLGVYYCLQSTHFPQTFGGGTKLEIK

SEQ ID NO: 437 - protein, 107 aa, Artificial Sequence
  VL-64 Peptide Sequence
DILLTQSPSSMSVSLGDTVSITCHASQGINSNIGWLQQKPGKSFKGLIYHGTNLEDGVPSRFSGSGSGADYSLTISSLESEDFADYYCVQYDQFPWTFGGGTKLEIK

SEQ ID NO: 438 - protein, 112 aa, Artificial Sequence
  VL-65 Peptide Sequence
DIVMTQAAPSVPVTPGESVSISCRSSRSLLHSNGYTYLYWFLQRPGQSPRLLIYRMSNLASGVPDRFSGSGSGTAFTLRISRVEAEDVGVYYCMQHLEYPYTFGGGTKLEIK

SEQ ID NO: 439 - protein, 107 aa, Artificial Sequence
  VL-66 Peptide Sequence
DIQMTQTTSSLSASLGDRVTISCSASQGISNYLNWYQQKPDGTVKLLIYYTSSLHSGVPSRFSGSGSGTDYSLTISNLEPEDIATYYCQQYSKLPRTFGGGTKLEIN

SEQ ID NO: 440 - protein, 112 aa, Artificial Sequence
  VL-67 Peptide Sequence
DVVMTQTPLTLSVTIGQPASISCKSSRSLLDSDGKTYLNWLLQRPGQSPKRLIYLVSKLDSGVPDRFTGSGSGTDFTLKISRVEAEDLGVYYCWQGTHFPQTFGGGTKLEIN

SEQ ID NO: 441 - protein, 107 aa, Artificial Sequence
  VL-68 Peptide Sequence
DIQMNQSPSSLSASLGDTITITCHASQNINVWLSWYQQKPGNIPKLLIYQASNLHTGVPSRFSGRGSGTGFTLTISSLQPEDIATYYCQQGQSSPFTFGSGTKLEIK

SEQ ID NO: 442 - protein, 107 aa, Artificial Sequence
  VL-69 Peptide Sequence
DILMTQSHKFMSTSVGDRVSITCKASQDVSSVVVWYQQKPGQSPKQLIYWASTRHTGVPDRFTGSGSGTDYTLTISSVQAEDLALYYCQQHYSTPYTFGGGTKLEIK

SEQ ID NO: 443 - protein, 109 aa, Artificial Sequence
  VL-70 Peptide Sequence
QAVVTQESALTTSPGETVTLTCRSSTGAVTTSNYANWDQEKPDHLFTGLIGGTNNRAPGVPARFSGSLIGDKAALTITGAQTEDEAIYFCALWYSNHLVFGGGTKVTVL

SEQ ID NO: 444 - protein, 111 aa, Artificial Sequence
  VL-71 Peptide Sequence
DIVMTQSPASLPVSLGQRATISCRASKSVTTSAYSYIHWYQQRPGQPPKLLIYLASNLESGVPARFSGSGSGTDFTLNIHPVEEEDAATYYCQHNRELPPTFGGGTKLEIN

SEQ ID NO: 445 - protein, 107 aa, Artificial Sequence
  VL-72 Peptide Sequence
DIVLTQSPATLSVTPGDSVSFSCRASQIINNNLHWYQQKSHESPRLLIRYTSQSISGIPSRFSGSGSGTDFTLSINNVETEDFGMYFCQQTNSWPLTFGAGTKLELK

SEQ ID NO: 446 - protein, 111 aa, Artificial Sequence
  VL-73 Peptide Sequence
DVVMTQTPLTLSVTIEQTASISCKSSQSLLDRDGKTYLNWLLQRPGQSPKRLIYLVSKLDSGVPDRFTGSGSGTDFTLKISRVEAEDLGVYYCWQGTHFPTFGGGTKLEIK

SEQ ID NO: 447 - protein, 107 aa, Artificial Sequence
  VL-74 Peptide Sequence
DVVMTQTPKFLPITAEDRVTITCKASQSVSNEVAWYQQKPGQSPKLLIYYASNRYTGVPDRFTGSGSGTDFTFTIRSVQLEDLAVYFCQQHYSSPWTFGGGTKLEIK

SEQ ID NO: 448 - protein, 442 aa, Artificial Sequence
  TB001 heavy chain peptide sequence
QVQLVQSGSELKKPGASVKVSCKASGYTFTNYGMNWVRQAPGQGLKWMGWINTNTGEPTYVEEFTGRFVFSLETSVSTAYLQISSLKAEDTAVYFCAPYDNFFAYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 449 - protein, 442 aa, Artificial Sequence
  TB006 heavy chain peptide sequence
QVQLVQSGAEVKKPGASVKVSCKASGYSFTNYYMHWVRQAPGQRLEWMGWIYPGSGNTNYNEKFQGRVTITADTSASTAYMELSSLRSEDTAVYYCSTAPGGFDVWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 450 - protein, 452 aa, Artificial Sequence
  12G5.D7 heavy chain peptide sequence
QVQLKQSGAELVRPGASVKLSCKASGYTFTDYYINWVKQRPGQGLEWIARIYPGTGNTDYNEKFKGRATLTAEKSSSTAYMQLSSLTSEDSAVYFCARFAYYYGSGGYFDYWGHGTTLTVSSAKTTPPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNAAGGPSVFIFPPKIKDVLMISLSPIVTCVVVDVSEDDPDVQISWFVNNVEVHTAQTQTHREDYNSTLRVVSALPIQHQDWMSGKEFKCKVNNKDLGAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 451 - protein, 449 aa, Artificial Sequence
  13A12.2E5 heavy chain peptide sequence
QIQLVQSGPELKKPGETVKISCKTSGYKFKTYVMSWVKQAPGKALKWMGWINTYSGVPTYADDFKGRFAFSLETSASTAYLEIINLKNEDTATYFCARDGNYGDPMDYWGQGTSVTVSSAKTTPPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNAAGGPSVFIFPPKIKDVLMISLSPIVTCVVVDVSEDDPDVQISWFVNNVEVHTAQTQTHREDYNSTLRVVSALPIQHQDWMSGKEFKCKVNNKDLGAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 452 - protein, 447 aa, Artificial Sequence
  14H10.2C9 heavy chain peptide sequence
QIQLVQSGPELKKPGETVKISCKASGYTFTTYGMGWVKQAPGKDLKWMGWINTYSGVPTYADDFKGRFAFSLETSASTAYLQISNLKNEDTATYFCSTPYEYDGAYWGQGTLVTVSAAKTTPPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNAAGGPSVFIFPPKIKDVLMISLSPIVTCVVVDVSEDDPDVQISWFVNNVEVHTAQTQTHREDYNSTLRVVSALPIQHQDWMSGKEFKCKVNNKDLGAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 453 - protein, 443 aa, Artificial Sequence
  15F10.2D6 heavy chain peptide sequence
EVQLVESGGGLVKPGGSLKLSCAASGFAFSSYAMSWVRQTPEKRLEWVATISDGGVYTYYTDHVKGRFTISRDNAEDNLYLQMSHLKSEDTAMYYCVRDGGYWGQGTTLTVSSAKTTPPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNAAGGPSVFIFPPKIKDVLMISLSPIVTCVVVDVSEDDPDVQISWFVNNVEVHTAQTQTHREDYNSTLRVVSALPIQHQDWMSGKEFKCKVNNKDLGAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 454 - protein, 446 aa, Artificial Sequence
  19B5.2E6 heavy chain peptide sequence
QIQLVQSGPELKKPGETVKISCKASGYTFTTYAMSWVKQAPGKGLKWMGWINTYSGVPTYADDLKGRFAFSLETSASTAYLQINNLKNEDTATYFCARGPYAMDYWGQGTSVTVSSAKTTPPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNAAGGPSVFIFPPKIKDVLMISLSPIVTCVVVDVSEDDPDVQISWFVNNVEVHTAQTQTHREDYNSTLRVVSALPIQHQDWMSGKEFKCKVNNKDLGAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 455 - protein, 445 aa, Artificial Sequence
  20D11.2C6 heavy chain peptide sequence
EVQLQQSGPELVKPGASVKISCKASGYTFTDFYINWVKQSHGKSLEWIGDINPKNGGINYNPKFKIKATLTVDKSSSTSYMDLRGLTSEDSAVYYCTSGYGFPYWGQGTLVTVSAAKTTPPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNAAGGPSVFIFPPKIKDVLMISLSPIVTCVVVDVSEDDPDVQISWFVNNVEVHTAQTQTHREDYNSTLRVVSALPIQHQDWMSGKEFKCKVNNKDLGAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 456 - protein, 446 aa, Artificial Sequence
  20H5.A3 heavy chain peptide sequence
QIQLVQSGPELKKPGESVKISCKASGYAFTTYGMSWVQQAPGKGLKWMGWVNTYSGVPTCADDFKGRFAFSLETSASTAYLQINNLRNEDTATYFCARGPYAMDYWGQGTSVTVSSAKTTPPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNAAGGPSVFIFPPKIKDVLMISLSPIVTCVVVDVSEDDPDVQISWFVNNVEVHTAQTQTHREDYNSTLRVVSALPIQHQDWMSGKEFKCKVNNKDLGAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 457 - protein, 446 aa, Artificial Sequence; identical to SEQ ID NO: 454
  23H9.2E4 heavy chain peptide sequence

SEQ ID NO: 458 - protein, 450 aa, Artificial Sequence
  2D10.2B2 heavy chain peptide sequence
QVQLQQSGPELVKPGASVKISCKASGYTFTDYYINWVKQRPGQGLEWIGWIYPGSNDTKYNEKFKGKATLTVDTSSSTAYMQLGSLTSEDSAVYFCANYFGCSGWFFDVWGTGTTVTVSSAKTTPPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNAAGGPSVFIFPPKIKDVLMISLSPIVTCVVVDVSEDDPDVQISWFVNNVEVHTAQTQTHREDYNSTLRVVSALPIQHQDWMSGKEFKCKVNNKDLGAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 459 - protein, 449 aa, Artificial Sequence; identical to SEQ ID NO: 451
  3B11.2G2 heavy chain peptide sequence

SEQ ID NO: 460 - protein, 443 aa, Artificial Sequence
  7D8.2D8 heavy chain peptide sequence
EVQLVESGGGLVKPGGSLKLSCAASGFTFSSYAMSWVRQTPEKRLEWVATISDGGIYTYYPDNVKGRFTISRDNAKNNLFLQMSHLKSEDTAMYYCVRDGGYWGQGTTLTVSSAKTTPPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNAAGGPSVFIFPPKIKDVLMISLSPIVTCVVVDVSEDDPDVQISWFVNNVEVHTAQTQTHREDYNSTLRVVSALPIQHQDWMSGKEFKCKVNNKDLGAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 461 - protein, 446 aa, Artificial Sequence
  mTB001 heavy chain peptide sequence
QIQLVQSGPELKKPGETVKISCKASGYTFTNYGMNWVKQAPGKGLKWMGWINTNTGEPTYVEEFKGRFAFSLETSASTAYLQINNLKNEDTATYFCAPYDNFFAYWGQGTLVTVSAAKTTPPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNAAGGPSVFIFPPKIKDVLMISLSPIVTCVVVDVSEDDPDVQISWFVNNVEVHTAQTQTHREDYNSTLRVVSALPIQHQDWMSGKEFKCKVNNKDLGAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 462 - protein, 442 aa, Artificial Sequence
  4A11.2B5 heavy chain peptide sequence
QVQLQQSGPELVKPGASVKISCKASGYSFTNYYIHWVKQRPGQGLEWIGWIYPGSGNTNYNEKFKGKATLTADTSSSTTNMQLSSLTSEDSAVYYCSTAPGGFDVWGSGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 463 - protein, 442 aa, Artificial Sequence
  4A11.H1L1 heavy chain peptide sequence
QVQLVQSGAEVKKPGASVKVSCKASGYSFTNYYMHWVRQAPGQGLEWMGWIYPGSGNTNYNEKFQGRVTMTADTSISTAYMELSRLRSDDTAVYYCSTAPGGFDVWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 464 - protein, 442 aa, Artificial Sequence
  4A11.H4L2 heavy chain peptide sequence
QVQLVQSGAEVKKPGASVKVSCKASGYSFTNYYIHWVRQAPGQRLEWMGWIYPGSGNTNYNEKFQGRVTLTADTSASTTYMELSSLRSEDTAVYYCSTAPGGFDVWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 465 - protein, 445 aa, Artificial Sequence
  4G2.2G6 heavy chain peptide sequence
QIQLVQSGPDLKKPGETVKISCKASGYTFTTYVMSWVKQAPGKDLKWMGWINTHSGVPTYADDFKGRFDFSLETSANTAFLQINNLKNEDTATYFCTRDGNDGDAMDNWGQGTSVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 466 - protein, 446 aa, Artificial Sequence
  6B3.2D3 heavy chain peptide sequence
QVQLKQSGPGLVQPSQSLSITCTVSGFSLTSYGVHWVRQPPGKGLEWLGVIWSGGSTDYNAAFISRLSISKDNSKSQVFFKMNSLQADDTAIYYCAKGPYDYDLGWFAYWGQGTLVTVSAASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 467 - protein, 442 aa, Artificial Sequence
  6H6.2D6 heavy chain peptide sequence
QIQLVQSGPELKKPGETVKISCKASGYTFTTYGMSWVKQAPGKGLKWMAWINTYSGVPTYADDFKGRFAFSLETSASTAYLQINNLTNEDTATYFCARGPYAMDYWGQGTSVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 468 - protein, 441 aa, Artificial Sequence
  9H2.2H10 heavy chain peptide sequence
QVQLQQPGAELVGPGSSVKLSCKASGYTFTNYWIHWVKQRPLQGLEWIGNIDPSDSETHYNQKFKDKATLTVDKSSSTAYMQLSSLTSEDSAVYYCARHGYYDYWGQGTTLTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 469 - protein, 445 aa, Artificial Sequence
  13G4.2F8 heavy chain peptide sequence
QVQLQQPGAELVKPGASVKLSCKASGYTFTSYWMHWVKQRPGQGLEWIGMIHPNSGSTDYNEKFKNKATLNVDKSSSTAYIQLSSLTSEDSAVYYCTRWGIYYYARDYWGQGTTLTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 470 - protein, 443 aa, Artificial Sequence
  13H12.2F8 heavy chain peptide sequence
QIQLVQSGPELKKPGETVKISCKASGYTFTTYGMSWVKQAPGKGLKWMGWINTYSGVPTYADDFKGRFAFSLETSASTAYLQINNLKNEDTATYFCAVPYEYDGAYWGQGTLVTVSAASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 471 - protein, 441 aa, Artificial Sequence
  15G7.2A7 heavy chain peptide sequence
EVQLQQSGPELVKPGASVKISCKASGYTFTDYYMNWVKQSHGKSLEWIGDINPNNGGTNYNQKFKGKATLTVDKSSSTAYMELRSLTSEDSAVYYCTSGYGFPYWGQGTLVTVSAASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 472 - protein, 443 aa, Artificial Sequence
  19D9.2E5 heavy chain peptide sequence
QIQLVQSGPELKKPGETVKISCKASGYTFTTYGMGWVKQAPGKGLKWMGWINTYSGVPTYADDFKGRFAFSLETSTSTAYLQINNLKNEDMATYFCATPYEYDGAYWGQGTLVTVSAASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 473 - protein, 438 aa, Artificial Sequence
  23B10.2B12 heavy chain peptide sequence
QVQLQQSGPELVKPGDSVKISCKAAGYTFSDYYINWVKQRPGQGLEWIGWIYPVSVNTKYNEKFKGKATLTVDTSSSTAYMQLSSLTSEDSGVYFCAYLDYWGQGTLVTVSAASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 474 - protein, 446 aa, Artificial Sequence
  24D12.2H9 heavy chain peptide sequence
QVQLKQSGPGLVQPSQSLSITCTVSGFSLTSYGVHWVRQAPGKGLEWLGVIWSGGSTDYNAAFMSRLSISKDNSKSQVFFKMNSLQADDTAIYYCAKSPDGYDVAWFGYWGQGTLVTVSAASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 475 - protein, 448 aa, Artificial Sequence
  F846C.1B2 heavy chain peptide sequence
QIQLVQSGPELKKPGETVKISCKASGYTFTNYGMNWVKQAPGKGLKWMGWINTYTGEPSYADDFKGRFAFSLETSASTAYLQINNLKNEDMATYFCARWGGYAGDYYAMDFWGQGTSVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 476 - protein, 448 aa, Artificial Sequence
  F846C.1F5 heavy chain peptide sequence
QIQLVQSGPELKKPGETVKISCKASGYTFTNYGMNWVKQAPGKGLKWMGWINTYTGEPSYADDFKGRFAFSLETSASTAYLQINNLKNEDMATYFCARWGGYDGDYYAMDYWGQGTSVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 477 - protein, 448 aa, Artificial Sequence
  F846C.1H12 heavy chain peptide sequence
QIQLVQSGPELKKPGETVKISCKASGYTFTNFGMNWVKQAPGKGLKWMGWINTYTGEPSYADDFKGRFAFSLETSASTAYLQINNLKNEDIATYFCARWGGYAGDYYAMDYWGQGTSVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 478 - protein, 442 aa, Artificial Sequence
  F846C.1H5 heavy chain peptide sequence
EVQLLESGGGLVKPGGSLKLSCAASGFTFSSYAMSWVRQTPEKRLEWVASISSGGDTYYPDSVKGRFTISRDNARNILYLQMSSLRSEDTAMYYCASYGNSLFDYWGQGTTLTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 479 - protein, 448 aa, Artificial Sequence; identical to SEQ ID NO: 476
  F846C.2H3 heavy chain peptide sequence

SEQ ID NO: 480 - protein, 440 aa, Artificial Sequence
  F846TC.14A2 heavy chain peptide sequence
QIQLVQSGPELKKPGETVKISCKASGYTFTNYGMNWVKQAPGKGLKWMGWINTYTGEPTYAGDLKGRFAFSLETSASTAYLQINNLKNEDTATYFCVRYTMDYWGQGTSVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 481 - protein, 450 aa, Artificial Sequence
  F846TC.14E4 heavy chain peptide sequence
QVTLKESGPGILQPSQTLSLTCSFSGFSLSTSGMGVGWIRQPSGKGLEWLAHIWWDDDKYYNTALKSGLTISKDASKNQVFLKIASMDTADTATYYCARNLYDGSYGYYAMDYWGQGTSVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 482 - protein, 448 aa, Artificial Sequence
  F846TC.16B5 heavy chain peptide sequence
QIQLVQSGPELKKPGETVKISCKASGYTFTNYGMNWVKQAPGKGLKWMGWINTYTGEPAYADDFKGRFAFSLETSASTAYLQINNLKNEDMATYFCARWGGYDGDYYAMDYWGQGTSVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 483 - protein, 449 aa, Artificial Sequence
  F846TC.7F10 heavy chain peptide sequence
EVQLVESGGDLVKPGGSLKLSCAASGFTFSNYGLSWIRQTPDKRLEWVATISSGGSYTYYPDSVKGRFTISRDSAKNTLYLQMSSLKSEDTAMYYCARHAHYYGVSPYYFDYWGQGTCLTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 484 - protein, 445 aa, Artificial Sequence
  F847C.10B9 heavy chain peptide sequence
QIQLVQSGPEVKKPGETVKISCKASGYIFTNYGMNWVKQAPGKGLKWMGWINTYTGEPTYTDDFKGRFAFSLETSASTAYLQINNLKNEDTATYFCAKFGNYVGAMDYWGQGTSVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 485 - protein, 446 aa, Artificial Sequence
  F847C.11B1 heavy chain peptide sequence
EVQLQQSGPELVKPGASVKISCKASGNTFTDHNMHWVKQSHGKSLEWIGYIYPYNGGTGYNQKFKSKATLTVDNSSSTVYMELRSLTSEDSAVYYCARGEYDYLAWFAYWGQGTLVTVSAASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 486 - protein, 445 aa, Artificial Sequence
  F847C.12F12 heavy chain peptide sequence
QIQLVQSGPELKKPGETVKISCKASGYTFTNYGMNWVKQAPGKGLKWMGWINTYTGEPTYVDDFKGRFAFSLETSASTAYLRINNLKNEDTATYFCAKFGNYVGAMDYWGQGTSVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 487 - protein, 445 aa, Artificial Sequence; identical to SEQ ID NO: 484
  F847C.26F5 heavy chain peptide sequence

SEQ ID NO: 488 - protein, 443 aa, Artificial Sequence
  F847C.4B10 heavy chain peptide sequence
EVQLVETGGGLVKPGGSLKLSCAASGFTFSSYAMSWVRQTPEKRLEWVASISSGGSTYYPDSVKGRFTISRDNARNILYLQMSSLRSEDTAMYYCTRFTTVVEMDYWGQGTSVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 489 - protein, 438 aa, Artificial Sequence
  F849C.8D10 heavy chain peptide sequence
QVQLQQTGAELVKPGASVKLSCKASGYTFTSYWINWVKQRPGQGLEWIGNIYPGSSSIYYSEKFKSKATLTVDTSSSTAYMQLSSLTSDDSAVYYCARWGYWGQGTTLTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 490 - protein, 447 aa, Artificial Sequence
  F849C.8H3 heavy chain peptide sequence
QVTLKESGPGILQPSQTLSLTCSFSGFSLSTFGMGVGWIRQPSGKGLEWLAHIWWDDDKHYNPALKSRLTISKDTSKNQVFLRIANVDTADNATYYCARIDYGDYVGFAYWGQGTLVTVSAASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 491 - protein, 444 aa, Artificial Sequence
  846.2B11 heavy chain peptide sequence
QVQLQQSGPELVRPGALVKISCKASGYTFTSYDINWVKQRPGQGLEWIGWIYPGDGSTKYNEKFKGKATLTADKSSSTAYMQLSSLTSENSAVYFCAREAASNAMDYWGQGTSVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 492 - protein, 448 aa, Artificial Sequence
  846.4D5 heavy chain peptide sequence
EVKLEESGGGLVQPGGSMKLSCVASGFTFSNYWMNWVRQSPEKGLEWVAEIRLKSNNYATHYAESVKGRFTISRDDSKSSVYLQMNNLRAEDTGIYYCTRHYGFPYWYFDVWGAGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 493 - protein, 444 aa, Artificial Sequence
  846T.1H2 heavy chain peptide sequence
QIQLVQSGPELKKPGETVKISCKASGYTFTNYGMNWVKQAPGKGLKWMGWINTNTGEPTYAEEFKGRFAFSLETSASTAYLQINNLKNEDTATYFCATGGGNWDFDYWGQGTTLTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 494 - protein, 440 aa, Artificial Sequence
  847.14H4 heavy chain peptide sequence
QIQLVQSGPELTKPGETVKISCKASGYTFTDYGMNWVRQAPGETLKWMGWINTYTGEPTYADDFKGRFAFSLESSASTAYLQINNLKNEDVATYFCARYPMDYWGQGTSVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 495 - protein, 219 aa, Artificial Sequence
  TB001 light chain peptide sequence
DIVLTQSPLSLPVTPGEPASISCRSSKSLLYKDGKTYLNWFLQKPGQSPQLLIYLMSTHASGVPDRFSGSGSGTDFTLKISRVEAEDVGVYYCQQLVDYPLTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 496 - protein, 219 aa, Artificial Sequence
  TB006 light chain peptide sequence
DIVMTQTPLSLSVTPGQPASISCKSSKSLLHSDGITYLYWYLQKPGQSPQLLIYRMSNLASGVPDRFSGSGSGTDFTLKISRVEAEDVGVYYCAQMLEFPLTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 497 - protein, 214 aa, Artificial Sequence
  12G5.D7 light chain peptide sequence
DILMTQSPSSMSVSLGDTVSITCHASQGINSNMGWLQQKPGKSFKGLIYHATNLEDGVPSRFSGSGSGADYSLTISSLESEDFADYYCVQYAQFPPTFGSGTKLEIKRADVAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 498 - protein, 219 aa, Artificial Sequence
  13A12.2E5 light chain peptide sequence
DVVMTQTPLTLSVAIGQPASISCKSSQSLLYTNGKTYLNWLLQRPGQSPKRLIYLLSKLDSGVPDRFSASGSGTDFTLKISRVEAEDLGVYYCLQSTHFPLTFGAGTKLEMKRADVAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 499 - protein, 219 aa, Artificial Sequence
  14H10.2C9 light chain peptide sequence
DVVMTQTPLTLSVTIGQPASISCKSSQSLFDSDGKTYLNWLLQRPGQSPKRLIYLVSKLDSGVPDRFTGSGSGTDFTLKISRVEAEDLGVYYCWQGTHFPLTFGAGTKLEMKRADVAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 500 - protein, 219 aa, Artificial Sequence
  15F10.2D6 light chain peptide sequence
DVLMTQTPLSLPVSLGDQASISCRSSQSIVHNNGNTYLEWYLQKPGQSPKLLIYKVSNRFSGVPDRFSGSGSGTDFTLKISRVEAEDLGVYYCFQGSHVPLTFGGGTKLELKRADVAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 501 - protein, 214 aa, Artificial Sequence
  19B5.2E6/23H9.2E4 light chain peptide sequence
DIQMTQTTSSLSASLGDRVTISCSASQGINNYLNWYQQKPDGTVKLLIYYASSLHSGVPSRFSGSGSGTDYSLTISNLEPEDIATYYCQQYSQVPYTFGSGTKLEIKRADVAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 502 - protein, 214 aa, Artificial Sequence
  20D11.2C6 light chain peptide sequence
DIQMNQSPSSLSASLGDTITITCRASQNIYIWLSWYQQKPGNIPKLLIYKASNLHTGVPSRFSGSGSGTDFTLTISTLQPEDIATYFCLQGQSYPLTFGAGTKLEMKRADVAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 503 - protein, 214 aa, Artificial Sequence
  20H5.A3 light chain peptide sequence
DIQMTQTTSSLSASLGDRVTINCSASQDISNYLNWYQQKPDGTVKLLIYYTSSLLSGVPSRFSGSGSGTDYSLTISNLEPEDIATYFCQQYSKLPYTFGSGTHLEIKRADVAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 504 - protein, 219 aa, Artificial Sequence
  2D10.2B2 light chain peptide sequence
DIVMTQAAFSNPVTLGTSASISCRSSKSLLHSDGITYLYWYLQRPGQSPQLLIYRMSNLASGVPDRFSGSGSGTDFTLRISRVEAEDVGVYYCAQMIEFPLTFGAGTILELKRADVAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 505 - protein, 219 aa, Artificial Sequence
  3B11.2G2 light chain peptide sequence
DVVMTQTPLTLSVAIGQPASISCKSSQSLLYTNGKTYLNWLLQRPGQSPKRLIYLVSKLDSGVPDRFSGSGSGTDFTLKISRVEAEDLGVYYCLQSTHFPLTFGAGTKLELKRADVAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 506 - protein, 219 aa, Artificial Sequence
  7D8.2D8 light chain peptide sequence
DVLMTQTPLSLPVSLGDQASISCRSSQSIVHSNGNTYLEWYLQKPGQSPKLLIYKVSNRFSGVPDRFSGSGSGTDFTLKISRVEAEDLGVYYCFQGSHVPLTFGAGTKLELKRADVAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 507 - protein, 219 aa, Artificial Sequence
  mTB001 light chain peptide sequence
DIVITQDELSNPVTSGESVSISCRSSKSLLYKDGKTYLNWFLQRPGQSPQLLIYLMSTHASGVSDRFSGSGSGTDFTLEISRVKAEDVGVYYCQQLVDYPLTFGAGTKLELKRADVAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 508 - protein, 219 aa, Artificial Sequence
  4A11.2B5 light chain peptide sequence
DIVMTQAAFSNPVTLGTSASISCRSSKSLLHSDGITYLYWYLQRPGQSPQLLIYRMSNLASGVPDRFSGSGSGTDFTLRISRVEAEDVGVYYCAQMLEFPLTFGAGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 509 - protein, 219 aa, Artificial Sequence; identical to SEQ ID NO: 496
  4A11.H1L1 light chain peptide sequence

SEQ ID NO: 510 - protein, 219 aa, Artificial Sequence
  4A11.H4L2 light chain peptide sequence
DIVMTQSPLSLPVTPGEPASISCRSSKSLLHSDGITYLYWYLQKPGQSPQLLIYRMSNLASGVPDRFSGSGSGTDFTLKISRVEAEDVGVYYCAQMLEFPLTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 511 - protein, 219 aa, Artificial Sequence
  4G2.2G6 light chain peptide sequence
DVVMTQTPLTLSVTIGQPASISCKSSQSLLYTDGKTYLSWFLQRPGQSPKRLIYLVSKLDSGVPDRFSGSGSGTDFTLKISRVEAEDLGVYYCLQSTHFPLTFGAGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 512 - protein, 214 aa, Artificial Sequence
  6B3.2D3 light chain peptide sequence
SIVMTQTPKFLLVSAGDRVTITCKASQSVSNDVAWYQQKPGQSPKLLIYYASNRYTGVPDRFTGSGYGTDFTFTISTVQAEDLAVYFCQQDYTSPYTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 513 - protein, 214 aa, Artificial Sequence
  6H6.2D6 light chain peptide sequence
DIQMTQTTSSLSASLGDRVTISCSASQGISNYLNWYQQKPDGTVKLLIYYTSSLHSGVPSRFSGSGSGTDYSLTISNLEPEDIATYYCQQYSELPYTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 514 - protein, 214 aa, Artificial Sequence
  9H2.2H10 light chain peptide sequence
DIVMTQSHKFMSTSVGDRVSITCKASQDVSTAVAWYQQKPGQSPKLLIYWASTRHTGVPDRFTGSGSGTDYTLTISSVQAEDLALYYCQQHYTTPLTFGAGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 515 - protein, 214 aa, Artificial Sequence
  13G4.2F8 light chain peptide sequence
DIVMTQSQKFMSTSVGERVSITCKASQNVGTNVAWYQQKAGQSLELLIYGASNRHTGVPDRFTGSGSGTDFTLTITNVQSEDMTNYFCEQYSNFPLTFGAGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 516 - protein, 219 aa, Artificial Sequence
  13H12.2F8 light chain peptide sequence
DVVMTQTPLTLSVTIGQPASISCKSSQSLFHSDGKTYLNWLLQRPGQSPKRLIYLVSKLDSGVPDRFTGSGSGTDFTPKISRVEDEDLGVYYCWQGTHFPLTFGAGTKLEMKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 517 - protein, 214 aa, Artificial Sequence
  15G7.2A7 light chain peptide sequence
DIQMNQSPSSLSASLGDTISITCRASQNINIWLSWYQQKPGNIPQLLIYKASNLHTGVPSRFSGSGSGTDFTLTISSLQPEDIATYYCLQGQSYPLTFGAGTKLVMKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 518 - protein, 217 aa, Artificial Sequence
  19D9.2E5 light chain peptide sequence
DVVMTQTPLTLSVTIGQPASISCKSSQSLLHSDGKTYLNWLLQRPGQPPKRLMYLVSTLDSGVPDRFTGSGSGTDFTLKISRVEAEDLGVYYCWQGTHFPLTFGAGTKPERTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 519 - protein, 217 aa, Artificial Sequence
  23B10.2B12 light chain peptide sequence
DIVMTQAAFSNPVTLGTSASISCRSSKSLLHSDGITYFYWYLQRPGQSPQLLIYRMSNLASGVPDRFSGSGSGTDFTLRISRVEAEDVGVYYCAQMLEFPLTFGAGTKLERTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 520 - protein, 214 aa, Artificial Sequence
  24D12.2H9 light chain peptide sequence
DIVMTQSHKFMSTSVGDRVSITCKASQDVRTAVAWYQQKPGQSPKLLIYWASTRHTGVPDRFTGSGSGTDFTLTLSNVQSEDLADYFCQQYSSYPWTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 521 - protein, 219 aa, Artificial Sequence
  F846C.1B2 light chain peptide sequence
NIWLTQSPSSLAVSAGEMVTMTCKSSQSVLYSSNQKNYLAWYQQKPGQSPKLLIYWASTRESGVPDRFTGSGSGTDFSLTISSVQAEDLAVYYCHQYLSSLTFGAGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 522 - protein, 219 aa, Artificial Sequence
  F846C.1F5/F846C.2H3 light chain peptide sequence
NIMMTQSPSSLAVSAGEKVTMSCKSSQSVLYSSNQKNYLAWYQQKPGQSPKLLIYWASTRESGVPDRFTGSGSGTDFTLTISSVQPEDLAVYYCHQYLSSLTFGAGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 523 - protein, 219 aa, Artificial Sequence
  F846C.1H12 light chain peptide sequence
NIMMTQSPSSLAVSAGQKVTMSCKSSQSVLYSSSQKNYLAWYQQKPGQSPKLLIYWASTRESGVPDRFSGSGSGTDFTLTISSVQPEDLAVYYCHQYLSSLTFGAGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 524 - protein, 219 aa, Artificial Sequence
  F846C.1H5 light chain peptide sequence
DVVMTQTPLSLPVSLGDQASISCRSSQSLVHNSGNTYLHWYLQRPGQSPNLLIYKVSNRFSGVPDRFSGSGSGTDFTLKISRVAAEDLGVYFCSQSTHVPPTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 525 - protein, 216 aa, Artificial Sequence
  F846TC.14A2 light chain peptide sequence
QAVVTQESALTTSPGETVTLTCRSSTGAVTTSNYANWVQEKPDHLFTGLIGGINNRVPGVPARFSGSLIGDKAALTITGAQTEDEAIYFCALWYSNHWVFGGGTKLTVLRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 526 - protein, 219 aa, Artificial Sequence
  F846TC.14E4 light chain peptide sequence
DIVMTQAAFSNPVTLGTSASISCRSSKSLLHTNGITFLYWYLQKPGQSPQPLIYQMSNLASGVPDRFSSSGSGTDFTLRISRVEAEDVGVYYCAQNLELPWTFGGGTKLEINRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 527 - protein, 219 aa, Artificial Sequence
  F846TC.16B5 light chain peptide sequence
NIMMTQSPSSLAVSAGEKVTMSCKSSQSVLYSSNQKNYLAWYQQKPGQSPKLLIYWASTRESGVPDRFTGSGSGTDFTLTISSVQAEDLAVYYCHQYLSSLTFGAGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 528 - protein, 220 aa, Artificial Sequence
  F846TC.7F10 light chain peptide sequence
DIVMTQSPSSLAMSVGQKVTMSCKSSQSLLNSSNQKNYLAWYQQKPGQSPKLLVYFASTRESGVPDRFIGSGSGTDFTLTISSVQAEDLADYFCQQHYSTPYTFGGGAKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 529 - protein, 214 aa, Artificial Sequence
  F847C.10B9 light chain peptide sequence
DIRMTQSPSSLSASLGDTITITCHASQNINVWLSWYQQKPGNIPKLLIYKASNLHTGVPSRFSGSGSGTGFTLTISSLQPEDIATYYCQQGQSYPYTFGGGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 530 - protein, 214 aa, Artificial Sequence
  F847C.11B1 light chain peptide sequence
EIVLTQSPASLSVTTGEKVTIRCITSIDIDDDMNWYQQKPGEPPKLLISEGNTLRPGVPSRFSSSGYGTDFVFTIENTLSEDVADYYCLQSDNKPLTFGAGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 531 - protein, 214 aa, Artificial Sequence
  F847C.12F12 light chain peptide sequence
DIQVIQSPSSLSASLGDTITITCHASQNINVWLSWYQQKPGNIPKLLIYKASNLHTGVPSRFSGSGSGTGFTLTISSLQPEDIATYYCQQGQSYPYTFGGGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 532 - protein, 214 aa, Artificial Sequence
  F847C.26F5 light chain peptide sequence
EIKMNQSPSSLSASLGDTITITCHASQNINVWLSWYQQKPGNIPKLLIYKASNLHTGVPSRFSGSGSGTGFTLTISSLQPEDIATYYCQQGQSYPYTFGGGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 533 - protein, 216 aa, Artificial Sequence
  F847C.4B10/847.14H4 light chain peptide sequence
QAVVTQESALTTSPGETVTLTCRSSTGAVTTSNYANWVQEKPDHLFTGLIGGTNNRAPGVPARFSGSLIGDKAALTITGAQTEDEAIYFCALWYSNHLVFGGGTKLTVLRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 534 - protein, 219 aa, Artificial Sequence
  F849C.8D10 light chain peptide sequence
DVLMTQTPLSLPVSLGDQASISCRSSQDIVHSSGNTYLEWYLQKPGQSLKLLIYKVSNRFSGVPDRFSASGSGTDFTLKISRVEAEDLGVYYCFQGSHVPPTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 535 - protein, 219 aa, Artificial Sequence
  F849C.8H3 light chain peptide sequence
DIGMRQAAFSNPVTLGTSASISCRSSKSLLYSNGITYLYWFLQKPGQSPQLLIYQMSNLASGVPDRFSSSGSGTDFTLRISRVEADDVGVYYCAQNLELPWTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 536 - protein, 218 aa, Artificial Sequence
  846.2B11 light chain peptide sequence
DIVLTQSPASLGVSLGQRATISCRASKSVSTSGYSYMHWYQQKPGQPPKLLIYLASILESGVPARFSGSGSGTDFTLNIHPVEEEDAAIYYCQHSRELPLTFGAGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 537 - protein, 218 aa, Artificial Sequence
  846.4D5 light chain peptide sequence
NIVLTQSPASLAVSLGQRATISCRASESVDSYGNSFMHWYQQKPGQPPKLLIYLASNLESGVPARFSGSGSRTDFTLTIDPVEADDAATYYCQQNNEDPWTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 538 - protein, 219 aa, Artificial Sequence
  846T.1H2 light chain peptide sequence
DVVMTQTPLTLSVTIGQPASISCKSSQSLLYSNGKTYLNWLLQRPGQSPKRLIYLVSKLDSGVPDRFTGSGSGTDFTLKISRVEAEDLGVYYCVQGTHFPQTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 539 - DNA, 348 bp, Artificial Sequence
  TB001 VH DNA sequence
caggtgcagctggtgcagtccggctccgagctgaaaaaacccggcgcctccgtgaaagtgtcctgcaaagcctccggctacacattcacaaactacggcatgaactgggtgaggcaggcccccggccagggcctgaaatggatgggctggatcaacacaaacacaggcgagcccacatacgtggaggagttcacaggcaggttcgtgttctccctggagacatccgtgtccacagcctacctgcagatctcctccctgaaagccgaggacacagccgtgtacttctgcgccccctacgacaacttcttcgcctactggggccagggcacaacagtgacagtgtcctcc

SEQ ID NO: 540 - DNA, 357 bp, Artificial Sequence
  TB006  VH DNA sequence
cagattcaattggttcagagcggctcagaactgaaaaagcctggagccagcgttaaagtgagctgtaaagccagtggatacacattcaccacttacgtcatgtcctgggttagacaggcccctggacaggggctggaatggatgggctggataaacactcactctggagtgcccacatacgccgacgactttacaggcaggttcgtgttttccctagatactagtgtgaatactgcatacttgcaaatctcttctctgaaagcagaggataccgccgtgtacttttgcacccgcgatgggaatgatggggatgccatggacaactggggccaggggacgactgtgacagtgtcttca

SEQ ID NO: 541 - DNA, 366 bp, Artificial Sequence
  12G5.D7 VH DNA sequence
caggtgcagctgaagcagtctggggctgagctggtgaggcctggggcttcagtgaagctgtcctgcaaggcttctggctacactttcactgactactatataaactgggtgaagcagaggcctggacagggacttgagtggattgcaaggatttatcctggaactggtaatactgactacaatgagaagttcaagggcagggccacactgactgcagaaaactcctccagcactgcctacatgcagctcagcagtctgacatctgaggactctgctgtctatttctgtgcaagatttgcgtattactacggtagtggagggtactttgactactggggccacggcaccactctcacagtctcctca

SEQ ID NO: 542 - DNA, 357 bp, Artificial Sequence
  13A12.2E5 VH DNA sequence
cagatccagttggtacagtctggacctgagctgaagaagcctggagagacagtcaagatctcctgcaagacttctgggtataaattcaaaacctatgtgatgagctgggtgaaacaggctccaggaaaggctttaaagtggatgggctggataaacacctactctggagtgccaacatatgctgatgacttcaagggacgatttgccttctctttggaaacctctgccagcactgcctatttggagatcatcaacctcaaaaatgaggacacggctacatatttctgtgcaagagatggtaactacggggatcctatggactactggggtcaaggaacctcagtcaccgtctcctca

SEQ ID NO: 543 - DNA, 351 bp, Artificial Sequence
  14H10.2C9 VH DNA sequence
cagatccagttggtacagtctggacctgagctgaagaagcctggagagacagtcaagatctcctgcaaggcttctgggtataccttcacaacctatggaatgggctgggtgaaacaggctccaggaaaggatttaaagtggatgggctggataaacacctactctggagtgccaacatatgctgatgacttcaagggacggtttgccttctctttggaaacctctgccagcactgcctatttgcagatcagcaacctcaaaaatgaagacacggctacatatttctgttcaaccccttatgaatacgacggggcttactggggccaggggactctggtcactgtctctgca

SEQ ID NO: 544 - DNA, 339 bp, Artificial Sequence
  15F10.2D6 VH DNA sequence
gaagtacagctggtggagtctgggggaggcttagtgaagcctggagggtccctgaaactctcctgtgcagcctctggattcgctttcagttcctatgccatgtcttgggttcgccagactccggaaaagaggctggagtgggtcgcaaccattagtgatggtggtgtttacacctactatacagaccatgtaaagggccgattcaccatctccagagacaatgccgaggacaacctgtacctgcaaatgagccatctgaagtctgaggacacagccatgtattattgtgtgagagatgggggctactggggccaaggcaccactctcacagtctcctca

SEQ ID NO: 545 - DNA, 348 bp, Artificial Sequence
  19B5.2E6 VH DNA sequence
cagatccaacttgttcagagcgggcctgaattgaagaaaccaggcgagactgtaaagatctcctgtaaggccagtggctatacattcaccacctacgcaatgagctgggtcaagcaggcacccggaaagggtctgaagtggatgggttggataaatacatactcaggcgtcccaacctacgctgatgatttgaaggggcgctttgccttttctcttgaaacctcagcatcaaccgcctacttgcagataaataacctcaaaaatgaagacaccgctacctatttctgcgcaagggggccttatgctatggactactggggccagggcacctctgtgactgtaagttct

SEQ ID NO: 546 - DNA, 345 bp, Artificial Sequence
  20D11.2C6 VH DNA sequence
gaggtccagctgcaacaatctggacctgaactggtgaagcctggggcttcagtgaagatatcctgtaaggcttctggatacacgttcactgacttctacataaactgggtgaagcagagccatggaaagagccttgagtggattggagatattaatcctaagaatggtggtattaactacaacccgaagttcaagatcaaggccacattgactgtagacaagtcctccagcacatcctacatggacctccgcggcctgacatctgaggactctgcagtctattactgcacctcaggctacggatttccttactggggccaagggactctggtcactgtctctgca

SEQ ID NO: 547 - DNA, 348 bp, Artificial Sequence
  20H5.A3 VH DNA sequence
cagatccagttggtacagtctggacctgagctgaagaagcctggagagtcagtcaagatctcctgcaaggcttctggttatgccttcacaacctatggaatgagctgggtgcaacaggctccaggaaagggtttaaagtggatgggctgggtaaacacctactctggagtgccaacatgtgctgatgacttcaagggacggtttgccttctctttggaaacctctgccagcactgcctatttgcagatcaacaacctcagaaatgaggacacggctacatatttctgtgcaagagggccctatgctatggactactggggtcaaggaacctcagtcaccgtctcctca

SEQ ID NO: 548 - DNA, 348 bp, Artificial Sequence
  23H9.2E4 VH DNA sequence
cagatccagttggtacagtctggacctgagctgaagaagcctggagagacagtcaagatctcctgcaaggcttctgggtataccttcacaacctatgcaatgagctgggtgaaacaggctccaggaaagggtttaaagtggatgggctggataaacacctactctggagtgccaacatatgctgatgacctcaagggacggtttgccttctctttggaaacctctgccagcactgcctatttgcagatcaacaacctcaaaaatgaggacacggctacatatttctgtgcaagagggccctatgctatggactactggggtcaaggaacctcagtcaccgtctcctca

SEQ ID NO: 549 - DNA, 360 bp, Artificial Sequence
  2D10-VH0-VL0 VH DNA sequence
caagtacagctccagcaatcaggacctgaacttgttaagccaggtgcaagcgtcaaaataagttgtaaagcatcaggttacacctttacagactactatatcaactgggtcaagcaacggcctggtcagggacttgaatggataggttggatctaccctgggtcacaagacaccaagtacaatgaaaaatttaaggggaaagccactctgacagtagatactagctcaagtaccgcctacatgcagctcggcagcctcacttccgaggactctgccgtatatttctgtgccaactacttcgggtcttctgggtggttctttgatgtgtggggaaccggcaccaccgtaaccgtttcctca

SEQ ID NO: 550 - DNA, 357 bp, Artificial Sequence
  3B11.2G2 VH DNA sequence
cagatccagttggtacagtctggacctgagctgaagaagcctggagagacagtcaagatctcctgcaagacttctgggtataaattcaaaacctatgtaatgagctgggtgaaacaggctccaggaaaggctttaaagtggatgggctggataaacacctactctggagtgccaacatatgctgatgacttcaagggacggtttgccttctctttggaaacctctgccagcactgcctatttggagatcatcaacctcaaaaatgaggacacggctacatatttctgtgcaagagatggtaattacggggatcctatggactactggggtcaaggaacctcagtcaccgtctcctca

SEQ ID NO: 551 - DNA, 339 bp, Artificial Sequence
  7D8.2D8 VH DNA sequence
gaagtgcagctggtggagtctgggggaggcttagtgaagcctggagggtccctgaaactctcctgtgcagcctctggattcactttcagtagctatgccatgtcttgggttcgccagactccggaaaagaggctggagtgggtcgcaaccatcagtgatggtggtatttacacctactatccagacaatgtaaagggccgattcaccatttccagagacaatgccaagaacaacctgttcctgcaaatgagccatctgaagtctgaggatacagccatgtattactgtgtaagagatgggggctactggggccaaggcaccactctcacagtctcctca

SEQ ID NO: 552 - DNA, 348 bp, Artificial Sequence
  mIMT001 VH DNA sequence
cagatccaacttgtgcagtcaggtccagaattgaagaagcctggtgagaccgtcaagatttcctgtaaggcctctggttatacttttaccaactatggcatgaattgggtcaagcaggcacctgggaagggtttgaaatggatggggtggataaataccaacacaggggaaccaacttacgttgaagagtttaagggtcgttttgcattcagtcttgagacttctgcaagcacagcttacctccaaattaacaatctcaaaaatgaagatactgctacatatttctgtgctccttatgataattttttcgcctactggggacagggaactctggtcaccgtctcagca

SEQ ID NO: 553 - DNA, 348 bp, Artificial Sequence
  4A11.2B5 VH DNA sequence
caggtacaacttcagcagagcggtccagaacttgtgaagcccggtgctagtgtcaaaatatcttgcaaagcaagtggttattccttcaccaactattacatacactgggtaaaacaacgtccagggcaaggactcgaatggattggttggatctaccccggcagcggcaacactaactacaacgagaagtttaaaggcaaagctactctcacagcagacacttctagcagtacaacaaatatgcagttgtcctctctgacttccgaagacagcgccgtctattactgttctactgcacccggaggttttgacgtctggggttccggcaccacagttaccgttagttcc

SEQ ID NO: 554 - DNA, 348 bp, Artificial Sequence
  4A11.H1L1 VH DNA sequence
caggtgcagctggtgcaatcaggagccgaagttaagaagcctggcgccagcgtcaaggtctcatgtaaagcctccggttacagtttcaccaactactatatgcactgggttaggcaagcaccaggccaggggcttgagtggatgggatggatctatccagggagcggtaacaccaattacaatgagaagtttcaagggcgcgtaaccatgacagcagataccagtataagcaccgcctatatggaactctctcggttgagatccgatgataccgctgtttattactgctctaccgcacctggtggtttcgacgtttggggccaaggtactacagtgaccgtatcatca

SEQ ID NO: 555 - DNA, 348 bp, Artificial Sequence
  4A11.H4L2 VH DNA sequence
caggtgcaactggtccagtctggggccgaggtcaaaaagcctggagcctccgtcaaagtgtcatgtaaagcctcagggtatagtttcaccaactactatatacattgggtcagacaagccccaggccagcgtcttgagtggatgggatggatttatcccggatcagggaatacaaactataacgagaaatttcaaggcagagttactctcactgccgatacctctgcaagtactacctatatggagctctccagtctcagaagcgaagacacagcagtatattactgtagcaccgccccaggcgggtttgacgtgtggggccaaggcactactgtaaccgttagctca

SEQ ID NO: 556 - DNA, 357 bp, Artificial Sequence
  4G2.2G6 VH DNA sequence
caaatacagctcgtgcagtctggtcccgatttgaagaagcctggagaaaccgtaaagataagctgtaaggctagtggttacactttcacaacatacgttatgtcatgggttaaacaggctcctggaaaagaccttaaatggatgggatggattaacacccatagcggtgtcccaacttacgctgacgattttaagggacgatttgacttttctctcgaaacttctgccaacacagcttttttgcagatcaacaatctcaagaatgaagacaccgcaacctatttctgcactcgagatgggaacgacggggatgcaatggataactggggacaaggcacatcagttaccgtgagctct

SEQ ID NO: 557 - DNA, 360 bp, Artificial Sequence
  6B3.2D3 VH DNA sequence
caggtgcagctgaagcagtcaggacctggcctagtgcagccctcacagagcctgtccatcacctgcacagtctctggtttctcattaactagttatggtgtacactgggttcgccagcctccaggaaagggtctggagtggctgggagtgatatggagtggtggaagcacagactataatgctgctttcatatccagactgagcatcagtaaggacaactccaagagccaagttttctttaaaatgaacagtctgcaagctgatgacactgccatatactactgtgccaaagggccttatgattacgacttaggctggtttgcttactggggccaagggactctggtcactgtctctgca

SEQ ID NO: 558 - DNA, 348 bp, Artificial Sequence
  6H6.2D6 VH DNA sequence
cagatccagctggtgcagtccggccccgagctgaagaagcccggcgagactgtgaagatctcctgcaaggcctccggctacaccttcaccacctacggcatgtcctgggtgaagcaggcccccggcaagggcctgaagtggatggcctggatcaacacctactccggcgtgcccacctacgccgacgacttcaagggcaggttcgccttctccctggagacttccgcctccaccgcctacctgcagatcaacaacctgaccaacgaggacaccgccacctacttctgcgccaggggcccctacgccatggactactggggccagggcacctccgtgaccgtgtcctcc

SEQ ID NO: 559 - DNA, 345 bp, Artificial Sequence
  9H2.2H10 VH DNA sequence
caggtccagctgcagcagcctggggctgaactggtggggcctgggtcttcagtgaagctgtcctgcaaggcttctggctacaccttcaccaactactggatacattgggtgaagcagaggcctctacaaggccttgaatggattggtaacattgacccttctgatagtgaaactcactacaatcaaaagttcaaggacaaggccacattgactgtagacaaatcctccagcacagcctacatgcaactcagcagcctgacatctgaggactctgcggtctattactgtgcaagacatggttactacgactactggggccaaggcaccactctcacagtctcctca

SEQ ID NO: 560 - DNA, 357 bp, Artificial Sequence
  13G4.2F8 VH DNA sequence
caggtccagctgcagcagcctggggctgagctggtaaagcctggggcttcagtgaagttgtcctgcaaggcttctggctacactttcaccagctactggatgcactgggtgaagcagaggcctggacaaggccttgagtggattggaatgattcatcctaacagtggtagtactgactacaatgagaagttcaagaacaaggccacactgaatgtagacaaatcctccagtacagcctacatacaactcagcagcctgacatctgaggactctgcggtctattactgtacaagatgggggatttattactacgcgagggactactggggccaaggcaccactctcacagtctcctca

SEQ ID NO: 561 - DNA, 351 bp, Artificial Sequence
  13H12.2F8 VH DNA sequence
cagatccagctggtccaatcaggacccgaactgaaaaaaccaggcgagacagtcaaaatcagctgtaaggcctcaggctacactttcacaacctacgggatgtcatgggtaaagcaagctcctggcaaggggctgaaatggatgggttggatcaacacatactctggagtgcccacctacgctgacgactttaagggtagattcgcatttagcctggaaacaagtgccagtacagcctacctccagataaacaacttgaaaaacgaggataccgcaacctatttttgcgccgtcccctacgagtacgacggtgcctattggggtcagggtacactcgtaacagtttccgcc

SEQ ID NO: 562 - DNA, 345 bp, Artificial Sequence
  15G7.2A7 VH DNA sequence
gaggtccagctgcaacaatctggacctgagctggtgaagcctggggcttcagtgaagatatcctgtaaggcttctggatacacgttcactgactactacatgaactgggtgaagcagagccatggaaagagccttgagtggattggagatattaatcctaacaatggtggtactaactacaaccagaagttcaagggcaaggccacattgactgtagacaagtcctccagcacagcctacatggagctccgcagcctgacatctgaggactctgcagtctattactgcacctcaggctacgggtttccttactggggccaggggactctggtcactgtctctgca

SEQ ID NO: 563 - DNA, 351 bp, Artificial Sequence
  19D9.2E5 VH DNA sequence
cagatccagttggtacagtctggacctgagctgaagaagcctggagagacagtcaagatctcctgcaaggcttctggatataccttcacaacctatggaatgggctgggtgaaacaggctccaggaaagggtttgaagtggatgggctggataaacacctactctggcgtgccaacatatgctgatgacttcaagggacggtttgccttctctttggaaacctctaccagcactgcctatttgcagatcaacaacctcaaaaatgaggacatggctacatatttctgtgcaaccccttatgaatacgacggggcttactggggccaagggactctggtcactgtctctgca

SEQ ID NO: 564 - DNA, 336 bp, Artificial Sequence
  23B10.2B12 VH DNA sequence
caggtccagctgcagcagtctggacctgaactggtgaagcctggggattctgtgaagatatcctgcaaggctgctggctacaccttcagtgactattatataaactgggtgaagcagaggcctggacagggacttgagtggattggatggatttatcctgtaagcgttaatactaagtacaatgagaagttcaagggcaaggccacattgactgtagacacatcctccagcacagcctacatgcagctcagcagcctgacctctgaggactctggggtctatttctgtgcctaccttgattattggggccaagggactctggtcactgtctctgca

SEQ ID NO: 565 - DNA, 360 bp, Artificial Sequence
  24D12.2H9 VH DNA sequence
caggtgcagctgaagcagtcaggacctggcctagtgcagccctcacagagcctgtccatcacctgcacagtctctggtttctcattaactagctatggtgtacactgggttcgccaggctccaggaaagggtctggaatggctgggagtgatatggagtggtggaagcacagactataatgctgctttcatgtccagactgagcatcagcaaggacaactccaagagccaagttttctttaaaatgaacagtctgcaagctgatgacactgccatatactactgtgccaaaagccctgatggttacgacgtcgcctggtttggttactggggccaagggactctggtcactgtctctgca

SEQ ID NO: 566 - DNA, 366 bp, Artificial Sequence
  F846C.1B2 VH DNA sequence
cagatccagttggtgcagtctggacctgagctgaagaagcctggagagacagtcaagatctcctgcaaggcttctgggtataccttcacaaactatggaatgaattgggtgaagcaggctccaggaaagggtttaaagtggatgggctggataaacacctacactggagagccatcatatgctgatgacttcaagggacggtttgccttctctttggaaacctctgccagcactgcctatttgcagatcaacaacctcaaaaatgaggacatggctacatatttctgtgcaagatgggggggttacgctggggattactatgctatggacttctggggtcaaggaacctcagtcaccgtctcctca

SEQ ID NO: 567 - DNA, 366 bp, Artificial Sequence
  F846C.1F5 VH DNA sequence
cagatccagttggtgcagtctggacctgagctgaagaagcctggagagacagtcaagatctcctgcaaggcttctgggtataccttcacaaactatggaatgaactgggtgaagcaggctccaggaaagggtttaaagtggatgggctggataaacacctacactggagagccatcatatgctgatgacttcaagggacggtttgccttctctttggaaacctctgccagcactgcctatttgcagatcaacaacctcaaaaatgaggacatggctacatatttctgtgcaagatgggggggttacgatggggattactatgctatggactactggggtcaaggaacctcagtcaccgtctcctca

SEQ ID NO: 568 - DNA, 366 bp, Artificial Sequence
  F846C.1H12 VH DNA sequence
cagatccagttggtgcagtctggacctgagctgaagaagcctggagagacagtcaagatctcctgcaaggcttctgggtataccttcacaaactttggaatgaactgggtgaagcaggctccaggaaagggtttaaagtggatgggctggataaacacctacactggagagccatcatatgctgatgacttcaagggacggtttgccttctctttggaaacctctgccagcactgcctatttgcagatcaacaacctcaaaaatgaggacattgctacatatttctgtgcaagatgggggggttacgctggggattactatgctatggactactggggtcaaggaacctcagtcaccgtctcctca

SEQ ID NO: 569 - DNA, 348 bp, Artificial Sequence
  F846C.1H5 VH DNA sequence
gaggtccagctgttggagtctgggggaggcttagtgaagcctggagggtccctgaaactctcctgtgcagcctctggattcactttcagcagctatgccatgtcttgggttcgccagactccagagaagaggctggagtgggtcgcatccattagtagtggtggtgacacctactatccagacagtgtgaagggccgattcaccatctctagagataatgccaggaacatcctgtacctgcaaatgagcagtctgaggtctgaggacacggccatgtattactgtgcaagttatggtaactccctctttgactactggggccaaggcaccactctcacagtctcctca

SEQ ID NO: 570 - DNA, 366 bp, Artificial Sequence; identical to SEQ ID NO: 567
  F846C.2H3 VH DNA sequence

SEQ ID NO: 571 - DNA, 342 bp, Artificial Sequence
  F846TC.14A2 VH DNA sequence
cagatccagttggtgcagtctggacctgagctgaagaagcctggagagacagtcaagatctcctgcaaggcttctgggtataccttcacaaactatggaatgaactgggtgaagcaggctccaggaaagggtttaaagtggatgggctggataaacacctacactggagagccaacatatgctggtgacctcaagggacggtttgccttctctttggaaacctctgccagcactgcctatttgcagatcaacaacctcaaaaatgaggacacggctacatatttctgtgtaagatatactatggactactggggtcaaggaacctcagtcaccgtctcctca

SEQ ID NO: 572 - DNA, 372 bp, Artificial Sequence
  F846TC.14E4 VH DNA sequence
caggttactctgaaagagtctggccctgggatattgcagccctcccagaccctcagtctgacttgttctttctctgggttttcactgagcacttctggtatgggtgtaggctggattcgtcagccttcagggaagggtctggagtggctggcacacatttggtgggatgatgataagtactataacacagccctgaagagcgggctcacaatctccaaggatgcctccaaaaaccaggtcttcctcaagatcgccagtatggacactgcagatactgccacatactactgtgctcgaaacctctatgatggttcctacgggtactatgctatggactactggggtcaaggaacctcagtcaccgtctcctca

SEQ ID NO: 573 - DNA, 366 bp, Artificial Sequence
  F846TC.16B5 VH DNA sequence
cagatccagttggtgcagtctggacctgagctgaagaagcctggagagacagtcaagatctcctgcaaggcttctgggtataccttcacaaactatggaatgaactgggtgaagcaggctccaggaaagggtttaaagtggatgggctggataaacacctacactggagagccagcatatgctgatgacttcaagggacggtttgccttctctttggaaacctctgccagcactgcctatttgcagatcaacaacctcaaaaatgaggacatggctacatatttctgtgcaagatgggggggttacgatggggattactatgctatggactactggggtcaaggaacctcagtcaccgtctcctca

SEQ ID NO: 574 - DNA, 369 bp, Artificial Sequence
  F846TC.7F10 VH DNA sequence
gaagtgcagctggtggagtctgggggagacttagtgaagcctggagggtccctgaaactctcctgtgcagcctctggattcactttcagtaactatggcttgtcttggattcgccagactccagacaagaggctggagtgggtcgcaaccattagtagtggtggtagttacacctactatcctgacagtgtgaaggggcgattcaccatctccagagacagtgccaagaacaccctgtacctgcaaatgagcagtctgaagtctgaggacacagccatgtattactgtgcaagacatgcgcattactacggtgttagcccgtactactttgactactggggccaaggcacctgtctcacagtctcctca

SEQ ID NO: 575 - DNA, 357 bp, Artificial Sequence
  F847C.10B9 VH DNA sequence
cagatccagttggtgcagtctggacctgaggtgaagaagcctggagagacagtcaagatctcctgcaaggcttctgggtatatcttcacaaactatggaatgaactgggtgaagcaggctccaggaaagggtttaaagtggatgggctggataaacacctacactggagagccaacatatactgatgacttcaagggacggtttgccttctctttggaaacctctgccagcactgcctatttgcagatcaacaacctcaaaaatgaggacacggctacatatttctgtgcaaagtttggtaactacgtgggagctatggactactggggtcaaggaacctcagtcaccgtctcctca

SEQ ID NO: 576 - DNA, 360 bp, Artificial Sequence
  F847C.11B1 VH DNA sequence
gaggtccagcttcagcagtctggacctgagctggtgaaacctggggcctcagtgaagatatcctgcaaggcttctggaaacacattcactgaccacaacatgcactgggtgaagcagagccatggaaagagccttgagtggattggatatatttatccttacaatggtggtactggctacaaccagaagttcaagagcaaggccacattgactgtagacaattcctccagcacagtctacatggagctccgcagcctgacatctgaggactctgcagtctattactgtgcaagaggggagtatgattacctggcctggtttgcttactggggccaagggactctggtcactgtctctgca

SEQ ID NO: 577 - DNA, 357 bp, Artificial Sequence
  F847C.12F12 VH DNA sequence
cagatccagttggtgcagtctggacctgagctgaagaagcctggagagacagtcaagatctcctgcaaggcttctgggtataccttcacaaactatggaatgaactgggtgaagcaggctccaggaaagggtttaaagtggatgggctggataaacacctacactggagagccaacatatgttgatgacttcaagggacggtttgccttctctttggaaacctctgccagcactgcctatttgcggatcaacaacctcaaaaatgaggacacggctacatatttctgtgcaaagtttggtaactacgtgggagctatggactactggggtcaaggaacctcagtcaccgtctcctca

SEQ ID NO: 578 - DNA, 357 bp, Artificial Sequence; identical to SEQ ID NO: 575
  F847C.26F5 VH DNA sequence

SEQ ID NO: 579 - DNA, 351 bp, Artificial Sequence
  F847C.4B10 VH DNA sequence
gaggtgcagcttgttgagactgggggaggcttagtgaagcctggagggtccctgaaactctcctgtgcagcctctggattcactttcagtagctatgccatgtcttgggttcgccagactccagagaagaggctggagtgggtcgcatccattagtagtggtggtagcacctactatccagacagtgtgaagggccgattcaccatctccagagataatgccaggaacatcctgtacctgcaaatgagcagtctgaggtctgaggacacggccatgtattactgtacaaggtttactacggtagtagagatggactactggggtcaaggaacctcagtcaccgtctcctca

SEQ ID NO: 580 - DNA, 336 bp, Artificial Sequence
  F849C.8D10 VH DNA sequence
caggtccaactgcagcagactggtgctgagcttgtgaagcctggggcctcagtgaagctgtcctgcaaggcttctggctatactttcaccagctactggataaactgggtgaagcagaggcctggacaaggccttgagtggattggaaacatttatcctggtagtagtagtatttactacagtgagaagttcaagagtaaggccacactgactgtagacacatcctccagcacagcctacatgcagctcagcagcctgacatctgacgactctgcggtctattattgtgcaagatggggctactggggccaaggcaccactctcacagtctcctca

SEQ ID NO: 581 - DNA, 363 bp, Artificial Sequence
  F849C.8H3 VH DNA sequence
caggttactctgaaagagtctggccctgggatattgcagccctcccagaccctcagtctgacttgttctttctctgggttttcactgagcacttttggtatgggtgtaggctggattcgtcagccttcagggaagggtctggagtggctggcacacatttggtgggatgatgataaacactataacccagccctgaagagccggctcacaatctccaaggatacctccaaaaaccaggtcttcctcaggatcgccaatgtggacactgcagataatgccacatattactgtgctcgaatcgactatggtgactacgtcgggtttgcttattggggccaagggactctggtcactgtctctgca

SEQ ID NO: 582 - DNA, 354 bp, Artificial Sequence
  846.2B11 VH DNA sequence
caggtccagctacagcagtctggacctgagctggtgaggcctggggctttagtgaagatttcctgcaaggcttctggttacaccttcacaagctacgatataaactgggtgaagcagaggcctggacagggacttgagtggattggatggatttatcctggagatggtagtactaaatataatgagaaattcaagggcaaggccacactgactgcagacaaatcctccagcacagcctacatgcagctcagcagcctgacttctgagaactctgcagtctatttctgtgcaagagaggcggcttctaatgctatggactactggggtcaaggaacctcagtcaccgtctcctca

SEQ ID NO: 583 - DNA, 366 bp, Artificial Sequence
  846.4D5 VH DNA sequence
gaagtgaagcttgaggagtctggaggaggcttggtgcaacctggaggatccatgaaactctcctgtgttgcctctggattcactttcagtaactactggatgaactgggtccgccagtctccagagaaggggcttgagtgggttgctgaaattagattgaaatctaataattatgcaacacattatgcggagtctgtgaaagggaggttcaccatctcaagagatgattccaaaagtagtgtctacctgcaaatgaacaacttaagagctgaagacactggcatttattactgtaccaggcactacggctttccctactggtacttcgatgtctggggcgcagggaccacggtcaccgtctcctca

SEQ ID NO: 584 - DNA, 354 bp, Artificial Sequence
  846T.1H2 VH DNA sequence
cagatccagttggtgcagtctggacctgagctgaagaagcctggagagacagtcaagatctcctgcaaggcttctgggtataccttcacaaactatggaatgaactgggtgaagcaggctccaggaaagggtttaaagtggatgggctggataaacaccaacactggagagccaacatatgctgaagagttcaagggacggtttgccttctctttggaaacctctgccagcactgcctatttgcagatcaacaacctcaaaaatgaggacacggctacatatttctgtgcaaccggggggggtaactgggactttgactactggggccaaggcaccactctcacagtctcctca

SEQ ID NO: 585 - DNA, 342 bp, Artificial Sequence
  847.14H4 VH DNA sequence
cagatccagttggtgcagtctggacctgaactgacgaagcctggagagacagtcaagatctcctgtaaggcttctggctataccttcacagactatggaatgaactgggtgaggcaggctccaggagagactttaaagtggatgggctggataaacacctacactggagagccaacatatgctgatgacttcaaggggcggtttgccttctctttggaatcctctgccagcactgcctatttgcagatcaacaacctcaaaaatgaggacgtggctacatatttctgtgcaagataccctatggactactggggtcaaggaacctcagtcaccgtctcctca

SEQ ID NO: 586 - DNA, 366 bp, Artificial Sequence
  846.2D4 VH DNA sequence
gaagtgaagcttgaggagtctggaggaggcttggtgcaacctggaggatccatgaaactctcctgtgttgcctctggattcactttcagtaactactggatgaactgggtccgccagtctccagagaaggggcttgagtgggttgctgaacttagattgaaatctaataattatgcaacacattatgcggagtctgtgaaagggaggttcaccatctcaagagatgattccaaaagtagtgtctacctgcaaatgaacaacttaagagctgaagacactggcatttattactgtaccaggcactacggctttccctactggtacttcgatgtctggggcgcagggaccacggtcaccgtctcctca

SEQ ID NO: 587 - DNA, 354 bp, Artificial Sequence
  846.2F11 VH DNA sequence
gaggtccagctgcagcagtctggacctgagctggtgaagcctggggcttcagtgaagatgtcctgcaaggcttctggatacacattcactagctatgttatgcactgggtgaagcagaagcctgggcagggccttgagtggattggatatattaatccttacaatgatggtactaagtacaatgagaagttcaaaggcaaggccacactgacttcagacaaatcctccagcacagcctacatggagctcagcagcctgacctctgaggactctgcggtctattactgtgcaagattacttttttactatgctatggactactggggtcaaggaacctcagtcaccgtctcctca

SEQ ID NO: 588 - DNA, 354 bp, Artificial Sequence
  846T.10B1 VH DNA sequence
caggttcagctgcagcagtctggacctgagctggtgaggcctggggctttagtgaagatttcctgcaaggcttctggttacaccttcacaagctacgatataaactgggtgaagcagaggcctggacagggacttgagtggattggatggatttatcctggagatggtagtactaaatacaatgagaaattcaagggcaaggccacactgactgcagacaaatcctccagcacagtttacatgcagctcagcagcctgacttctgagaactctgcagtctatttctgtgctagagaggcggcttctaatgccatggactactggggtcaaggaacctcagtcaccgtctcctca

SEQ ID NO: 589 - DNA, 354 bp, Artificial Sequence
  846T.2E3 VH DNA sequence
caggtccagctgcagcagtctggacctgagctggtgaagcctggggctttagtgaagatatcctgcaaggcttctggttacaccttcacaagctacgatataaactgggtgaagcagaggcctggacagggacttgagtggattggatggatttatcctggagatggtagtactaagtacaatgagaaattcaagggcaaggccgcactgactgcagacaagtcctccagcacagcctacatgcagctcagcagcctgacttctgagaactctgcagtctatttctgtgcaagagaggcggcttctaatgctatggactactggggtcaaggaacctcagtcaccgtctcctca

SEQ ID NO: 590 - DNA, 354 bp, Artificial Sequence
  846T.4C9 VH DNA sequence
gaggtccagctgcagcagtctggacctgagctggtaaagcctggggcttcagtgaagatgtcctgcaaggcttctggatactcattcactaactatattatgcactgggtgaagcagaagcctgggcagggccttgagtggattggatatattaatccttacaatgatggtactaagtacaatgagaagttcaaaggcaaggccacactgacttcagacaaatcctccagcacagcctacatggagctcagcagcctgacctctgaggactctgcggtctattactgtgcaagattacttttttactatgctatggactactggggtcaaggaacctcagtcaccgtctcctca

SEQ ID NO: 591 - DNA, 354 bp, Artificial Sequence
  846T.4E11 VH DNA sequence
caggttcagctgcagcagtctggagctgaactggtaaagcctggggcttcagtgaagttgtcctgcaaggcttctggctacaccttcagaagctatgatataaactgggtgaggcagaggcctgaacagggacttgagtggattggatggatttttcctggagaaggtatttctaagtacaatgagaagttcaagggcaaggccacactgactacagacaaattgtccagcacagcctacatgcagctcagcagcctgacatctgaggactctgctgtctatttctgtgcaagagaggctacggctggggctatggactactggggtcaaggaacctcagtcaccgtctcctca

SEQ ID NO: 592 - DNA, 366 bp, Artificial Sequence
  846T.4F5 VH DNA sequence
gaggtgaagcttctcgagtctggaggaggcttggtgcaacctggaggatccatgaaactctcctgtgttgcctctggattcactttcagtaacttctggatgaactgggtccgccagtctccagagaaggggcttgagtgggttgctgaaattagattgaaatctaataattatgcaacacattatgcggagtctgtgaaagggaggttcaccatctcaagagatgattccaaaagtagtgtctacctgcaaatgaacaacttaagagctgaagacactggcatttattactgtaccaggcactacggctttccctactggtacttcgatgtctggggcgcagggaccacggtcaccgtctcctca

SEQ ID NO: 593 - DNA, 354 bp, Artificial Sequence
  846T.8D1 VH DNA sequence
cagattcagttgcagcagtctggagctgaactggtaaagcctggggcttcagtgaagttgtcctgcaaggcttctggctacaccttcacaagctatgatatatgctgggtgaggcagaggcctgagcagggacttgagtggattggatggatttttcctggagatggtactactaagtacactgagaacttcaagggcaaggccacactgactacagacaaatcctccagcacagcctacatgcacctcagcaggctgacatctgaggactctgctgtctatttctgtgcaagggagggggcgggctcctggtttgcttactggggccaagggactctggtcactgtctctgca

SEQ ID NO: 594 - DNA, 342 bp, Artificial Sequence
  847.10C9 VH DNA sequence
gaggttcagctgcagcagtctggagctgagctggtgcggcctgggacttcagtgaaggtgtcctgcaaggcttcggaatacgccttcaataattacatgatggaatgggtaaaacagaggcctggacagggccttgagtggattggagtgattaatcccggaagtggtgctactaattacaatgagaatttcaaggacaaggcaacactgactgcagacaaatcctccaccactgcctacatgcagctcagcagcctgacatctgatgactctgcggtctatttctgtacctacaatgatcttggttactggggccaagggactctggtcactgtctctgca

SEQ ID NO: 595 - DNA, 369 bp, Artificial Sequence
  847.11D6 VH DNA sequence
gaggtcaagctgcagcagtctggacctgagctgatgaagcctggaacttcaatgaagatatcctgtaaggcttctggttactcattcaccggctacaccatgaactgggtgaagcagagccatggaaagaaccttgagtggattggacttattaatccttacaatggtggtactaactacaaccagaagttcaggggcaaggccacattaagtgtagacaagtcatccaacacagcctacatggagctcctcagtctgacatctgaagactctgcagtctattactgtgcaagaaaggacgattattacggaagtagtccctatgctctggactactggggtcaaggaacctcagtcaccgtctcctca

SEQ ID NO: 596 - DNA, 348 bp, Artificial Sequence
  847.15D12 VH DNA sequence
caggtccagctgcagcagtctggagctgagctgatgaagcctggggcctcagtgaagatatcctgcaaggctactggctacacattcactaactactggatagagtgggtaaagcagaggcctggacatggccttgaatggattggagaatttttacctggagatggcagtagtcactacaatgagaagttcaagggcaaggccacattcacttcagatacatcctccaacacagcctacatacacctcaccagcctgacatctgaggactctgccgtctattactgtgtaagagatgactacgacagtgactactgggcccaaggcaccactctcacagtctcctca

SEQ ID NO: 597 - DNA, 360 bp, Artificial Sequence
  847.15F9 VH DNA sequence
caggtgcagatgaagcagtcaggacctggcctagtgcagccctcacagagcctgtccatcacctgcacagtctctggtttctcattaatcaactatggtgtacactgggttcgccaatctccaggaaagggtctggagtggctgggagtgatatggagtggtggaagcacagactataatgcagctttcatatccagactgagcatcagcaaggacaattccaagagccaagttttctttaaaatgaacagtctgcaagctgatgacacagccatatattactgtgccagaatttattactacggtaggggctatgctatggactactggggtcaaggaacctcagtcaccgtctcctca

SEQ ID NO: 598 - DNA, 366 bp, Artificial Sequence
  847.15H11 VH DNA sequence
gaggtccagcttcagcagtctggggctgaagttgtgaagcctggggctccagtgaagctgtcctgcaaggcttctggctacaccttcaacaactactggctgaactgggtgaaacagcggcctggacgaggcctcgagtggattggaaggattgatccttccgatagtgaaactcactacaatcaaaagttcaaggacaaggccacactgactgtagacatgtcctccagcacagcctacatccaactcagcagcctgacatctgaggactctgcggtctattactgtgcaagaggggattattattacggtactaggggtcctatggactactggggtcaaggcacctcagtcaccgtctcctca

SEQ ID NO: 599 - DNA, 345 bp, Artificial Sequence
  847.20H7 VH DNA sequence
caggtccagctgcagcagtctggggctgagctggtgaggcctggggcttcagtgaacctgtcctgcaaggcttctggctacaccttcaccaactactggatgaactgggtgaagcagaggcctggacaaggccttgaatgggttggtatgattgatccttcagacagtgaaactcactacaatcaaatgttcaaggacaaggccacattgactatagacaaatcttccagcatagcctacatgcagctcagcagcctgacatctgaggactctgcggtctattactgtgcaagatggggtgctatggactactggggtcaaggaacctcagtcaccgtctcctca

SEQ ID NO: 600 - DNA, 363 bp, Artificial Sequence
  847.21B11 VH DNA sequence
caggtgcaactgaagcagtcaggacctggcctggtggcgccctcacagagcctgtccatcacttgcactgtctctggattttcattaaccagctatggtgtacactgggttcgccagcctccaggaaagggtctggagtggctgggaataatatgggctggtggaagcacaaattataatccggctctcatgtccagactgagcatcagcaaagacaaatccaagagccaagttttcttaaaaatgaacagtctgaaaactgatgacacagccatgtactactgtgccagagatcgggcttcattactacggccgggggctatggactactggggtcaaggaacctcagtcaccgtctcctca

SEQ ID NO: 601 - DNA, 354 bp, Artificial Sequence
  847.27B9 VH DNA sequence
cagatccagttggtgcagtctggacctgagctgaagaagcctggagagacagtcaagatctcctgcaaggcttctgggtataccttcacaaactatggaatgaactgggtgaagcaggctccaggaaagggtttaaagtggatgggctggataaacaccaacactggagagccaacatatgctgaagagttcaagggacggtttgccttctctttggagacctctgccagcactgcctatttgcagatcaactacctcaaaaatgaggacacggctacatttttctgtgcaagattggactatgattacgacgaggactactggggccaaggcaccactctcacagtctcctca

SEQ ID NO: 602 - DNA, 360 bp, Artificial Sequence
  847.28D1 VH DNA sequence
caggtgcagcttgtagagaccggacctggcctggtggcgccctcacagagcctgtccatcacttgcactgtctctgggttttcattaaccagctatggtgtacactggattcgtcagtctccaggaaagggtctggagtggctgggaactatatgggctggtggaagcacagattataattcgccactcatgtccagactgagcatcagcaaagacaactccaagaaccaagtttttttaaaaatgaatagtctgcagattgatgacacagccatatattattgtgccagtcctccttctgggtatgattacgacgtgtttgcttcctggggccaagggactctggtcactgtctctgca

SEQ ID NO: 603 - DNA, 360 bp, Artificial Sequence
  847.2B8 VH DNA sequence
caggtacaactgaagcagtcaggacctggcctagtgcagccctcacagagcctgtccatcacctgcacagtctctggtttctcattaatcaactatggtgtacactgggttcgccaatctccaggaaagggtctggagtggctgggagtgatatggagtggtggaagcacagactataatgcagctttcatatccagactgagcatcagcaaggacaattccaagagccaagttttctttaaaatgaacagtctgcaagctgatgacacagccatatattactgtgccagaatttattactacggtaggggctatgctatggactactggggtcaaggaacctcagtcaccgtctcctca

SEQ ID NO: 604 - DNA, 360 bp, Artificial Sequence
  847.3B3 VH DNA sequence
caggtgcagctgaaggagtcaggacctggcctggtggcgccctcacagagcctgtccatcacttgcactgtctctgggttttcattaaccagctatggtgtacactggattcgccagcctccaggaaagggtctggagtggctgggaggaatatgggctggtggaagtacagattacaattcgcctctcatgtcccgactgagtatcactaaagacaactccaagagccaagttttcttaaaaatgaacagtctgcaaagtgatgacacagccatgtactactgtgccagtcctccctctgggtatgattacgacgtgtttgcttactggggccaagggactctggtcactgtctctgca

SEQ ID NO: 605 - DNA, 360 bp, Artificial Sequence
  849.1D2 VH DNA sequence
caggtgcagctgaaggagtcaggacctgtcctggtggcgccctcacagagcctgtccatcacttgcactgtctctgggttttcattaagcagctatggtgtacactgggttcgccagcctccaggaaagggtctggagtggctgggagtaatatgggctggtggaagcacagattatgattcagctctcatgtccagactgagcatcagcaaagacaactccaagagccaagttttcttaaaaatggacagtctgcaaactgatgacacagccatgtactactgtgccaaacccccatatgattacgacggggcctggtttgcttactggggccaagggactctggtcactgtctctgca

SEQ ID NO: 606 - DNA, 342 bp, Artificial Sequence
  849.2D7 VH DNA sequence
caggtgcaactgcagcagtctgggcctcagctggttaggcctggggcttcagtgaagatatcctgcaaggcttctggttactcattcaccaactactggatgcactgggtgaagcagaggcctggacaaggtcttgagtggattggcatgattgatccttccgatagtgaaactaggttaaatcagaagttcaaggacaaggccacattgactgtagacaaatcctccagcacagcctacatgcaactcagcagcccgacatctgaggactctgcggtctattactgtgcaacggggagacccgactactggggccaaggcaccactctcacagtctcctca

SEQ ID NO: 607 - DNA, 342 bp, Artificial Sequence
  849.2F12 VH DNA sequence
caggtgcaactgcagcagtctgggcctcagctggttaggcctggggcttcagtgaagatatcctgcaaggcttctggttactcattcaccagctactggatgcactgggtgaagcagaggcctggacaaggtcttgagtggattggcatgattgatccttccgatagtgaaactaggttaaatcagaagttcaaggacaaggccacattgactgtagacaaatcctccagcacagcctacatgcaactcagcagcccgacatctgaggactctatagtctattactgtgcaaaggggagacccgactactggggccaaggcaccactctcacagtctcctca

SEQ ID NO: 608 - DNA, 354 bp, Artificial Sequence
  849.4B2 VH DNA sequence
gatggaaaacttcaggagtcaggacctggcctcgtgaaaccttctcagtctctgtctctcacctgctctgtcactggctactccatcaccagtggttattactggaactggatccggcagtttccaggaaacaaactggaatggatgggccacataagctacgatggtagaaataactacaacccatctctcaaaaatcgaatctccatcactcgtgacacatctaagaaccagtttttcctgaagttgaattctgtgactactgaggacacagccacatattactgtgcaggctatgatttcctctggtacttcgatgtctggggcacagggaccacggtcaccgtctcctca

SEQ ID NO: 609 - DNA, 363 bp, Artificial Sequence
  849.4F12 VH DNA sequence
caggtgcagctgaaggagtctggccctgggatattgcagccctcccagaccctcagtctgacttgttctttctctgggttttcactgagcacttttggtatgggtgtaggctggattcgtcagccttcagggaagggtctggagtggctggcacacatttggtgggatgatgataaacactataacccagccctgaagagccggctcacaatctccaaggatacctccaaaaaccaggtcttcctcaggatcgccaatgtggacactgcagataatgccacatattactgtgctcgaatcgactatggtgactacgtcgggtttgcttattggggccaagggactctggtcactgtctctgca

SEQ ID NO: 610 - DNA, 354 bp, Artificial Sequence
  849.4F2 VH DNA sequence
gatggacagcttcaggagtcaggacctggcctcgtgaaaccttctcagtctctgtctctcacctgctctgtcactggctactccatcaccagtggttattactggaactggatccggcagtttccaggaaacaaactggaatggatgggccacataagctacgatggtagaaataactacaacccatctctcaaaaatcgaatctccatcactcgtgacacatctaagaaccagtttttcctgaagttgaattctgtgactactgaggacacagccacatattactgtgcaggctatgatttcctctggtacttcgatgtctggggcacagggaccacggtcaccgtctcctca

SEQ ID NO: 611 - DNA, 357 bp, Artificial Sequence
  849.5C2 VH DNA sequence
gaggttcagctgcagcagtctggggcagagcttgtgaagtcaggggcctcagtcaagttgtcctgcacagcttctggcttcaacattaaagactactatatgcactgggtgaagcagaggactgaacagggcctggagtggattggaaggatttatcctgaggatgatgaaactaaatatgccccgaaattccagggcaaggccactataacagcagacacatcctccaacacagcctacctgcagctcagcagcctgacatctgaggacactgccgtctattactgtgctagatcagggggttactacgtttggtttgcttactggggccaagggactctggtcactgtctctgca

SEQ ID NO: 612 - DNA, 363 bp, Artificial Sequence
  849.8D12 VH DNA sequence
gaggtccagctacaacagtctggacctgagctggtgaagcctgggtcttcagtgaagatatcctgcaaggcttctagatacacattcactgactacaacatggactgggtgaagcagagccatggaaagagacttgagtggattggatatatttatcctaacaatggtggtactggctacaaccagaagttcaagggcaaggccacattgactgtagacaagtcctccagcacagcctacatggagctccgcagcctgacatctgaggactctgcagtctattactgtgcaaggtcctactacgatggtagctacgatgctatggactactggggtcaaggaacctcagtcaccgtctcctca

SEQ ID NO: 613 - DNA, 342 bp, Artificial Sequence
  F847C.21H6 VH DNA sequence
cagatccagttggtgcagtctggacctgagctgaagaagcctggagagacagtcaagatctcctgcaaggcttctgggtataccttcacaatctttggaatgaactgggtgaagcaggctccaggaaagggtttaaagtggatgggctgggtaaacacctacactggagagccaacatatgctgatgacttcaagggacggtttgccttctctttggaaacctctgccagcactgcctatttgcagatcaacaacctcaaaaatgaggacacggctacatatttctgtgcaagaggctggtttgcttactggggccaagggactctggtcactgtctctgca

SEQ ID NO: 614 - DNA, 360 bp, Artificial Sequence
  849.5H1 VH DNA sequence
caggtgcagctgaaggagtcaggacctgtcctggtggcgccctcacagagcctgtccatcacttgcactgtctctgggttttcattaaccagttatggtatacactgggttcgccagcctccaggaaagggtctggagtggctgggagtaatatgggctggtggaagcacaaattataattcagctctcatgtccagactgagcatcagcaaagacaactccaagagccaagttttcttaaaaatgaacagtctgcaaattgatgacacagccatgtactattgtgccaaacccccccatgattacgaccaggcctggtttgcttactggggccaagggactctgatcactgtctctgca

SEQ ID NO: 615 - DNA, 348 bp, Artificial Sequence
  847.23F11 VH DNA sequence
caggtccagctgcagcagtctggggctgagctggtgaggcctggggcttcagtgaagctgtcctgcaaggcttctggctacaccttcaccagctcctggatgaactgggtgaaacagaggcctggacaaggccttgactggattggtatgattgatccttcagacagtgaaactcactacaatcaaatgttcaaggacaaggccacattgactgtagacaaatcctctaacacagcctacatgcagctcagcaggctgacatctgaggactcagcggtctattactgtgtaaatagtaactacgagagtggctattggggccaaggcaccactctcacagtctcctca

SEQ ID NO: 616 - DNA, 348 bp, Artificial Sequence
  847.16D10 VH DNA sequence
caggtccagctgcagcagtctggggctgagctggtgaggcctggggcttcagtgaagctgtcctgcaaggcttctggctacaccttcaccggctactggttgaactgggtgaagcagaggcctggacaaggcctggaatggattggtatgattgatccttcagacagtgaaactcactacaatcaagtgttcaaggacaaggccacaatgactgtagacaggtcctccagcacagcctacatgcagctcagcggactgacatctgaggactctgcggtctattactgtgcaaatagtaactacgcgagtggctcctggggccagggcaccactctcacagtctcctca

SEQ ID NO: 617 - DNA, 360 bp, Artificial Sequence
  847.13E2-mH0mL1 VH DNA sequence
gaggtccagcttcagcagtctggacctgagctggtgaagcctggggcttcagtgaaggtttcctgcaaggcttctggttactcattcactgactacaacatgtactgggtgatgcagagccatggaaagagccttgagtggattggatatattgatccttacaatgatgctactagctacagccagaagttcacgggcaaggccacattgactgttgacaagtcctccagcacagccttcatgcatctcaacagcctgacatctgaggactctgcagtctattactgtgcaagatgggggaggtacgaatactatgctatggactattggggtcaaggaacctcagtcaccgtctcctca

SEQ ID NO: 618 - DNA, 360 bp, Artificial Sequence; identical to SEQ ID NO: 617
  847.13E2-mH0mL2 VH DNA sequence

SEQ ID NO: 619 - DNA, 345 bp, Artificial Sequence
  847.12C4 VH DNA sequence
caggtacagctgaaggagtcaggacctgaccttgtgcagccctcacagaccctgtctctcacctgcactgtctctgggttctcattaaccatctatggtgttcactgggttcgccagcctccaggaaagggactggagtgggtgggaacagtggcctgggatgacaaaaaatattataattcacctctacaatctcgactgagcatcagcagggatacctccaagaaccaagttttcttaaaactgagcagtctgcaaactgaagacacagccatgtactactgtactatgactgggggccctataaactactggggtccaggaacctcagtcaccgtctcctca

SEQ ID NO: 620 - DNA, 351 bp, Artificial Sequence
  847.4D3 VH DNA sequence
gaggtgcagctggtggagtctgggggaggcttagtgaagcctggagggtccctgaaactctcctgtgcagcctctggattcactttcagtagctatgccatgtcttgggttcgccagactccagagaagaggctggagtgggtcgcatccattagtagtggtgatagcccctactatccagacagtgtgaagggccgcttcaccatctccagagataatgccaggaacatcctgtacctgcaaatgagcagtctgaggtctgaggacacggccatgtattactgtacaaggtttactacggtagtagagatggactactggggtcaaggaacctcagtcaccgtctcctca

SEQ ID NO: 621 - DNA, 336 bp, Artificial Sequence
  TB001 VL DNA sequence
gacatcgtgctgacccagtctccactgagcctgcctgttacacctggcgagccagcctccatctcctgcagatcctctaagtccctgctgtacaaggacggcaagacctacctgaactggttcctgcagaagcccggccagtctcctcagctcctgatctacctgatgagcacccatgcctctggcgtgcccgatagattttccggctctggctctggcaccgacttcaccctgaagatctccagagtggaagccgaggacgtgggcgtgtactactgtcagcagctggtggactaccctctgacctttggcggcggaacaaagctggaaatcaag

SEQ ID NO: 622 - DNA, 336 bp, Artificial Sequence
  TB006 VL DNA sequence
gatatagtgatgacccaaacacctttgtccctgtcagtcaccccaggccaacccgcatctatctcatgcaaatcctcaaaaagtcttttgcactctgacgggataacatatctctactggtatcttcaaaaacctggtcagtccccccagctcttgatctatagaatgagtaaccttgcctctggtgtccccgaccggtttagtggaagcgggtctgggaccgacttcaccctcaagattagtcgcgtcgaagccgaagatgtgggagtgtattactgtgcccagatgctcgaatttcccctgacatttggtcaaggaactaaattggagattaag

SEQ ID NO: 623 - DNA, 321 bp, Artificial Sequence
  12G5.D7 VL DNA sequence
gacatcctgatgacccaatctccatcctccatgtctgtatctctgggagacacagtcagcatcacttgccatgcaagtcagggcattaactctaatatggggtggttgcagcagaaaccagggaaatcatttaagggcctgatctatcatgcaaccaacttggaagatggagttccatcaaggttcagtggcagtggatctggagcagattattctctcaccatcagcagcctggaatctgaagattttgcagactattactgtgtacagtatgctcagtttcctcctacgttcggatcggggaccaagctggaaataaaa

SEQ ID NO: 624 - DNA, 336 bp, Artificial Sequence
  13A12.2E5 VL DNA sequence
gatgttgtgatgacccagactccactcactttgtcggttgccattggacaaccagcttccatctcttgcaagtcgagtcagagcctcttatatactaatggaaaaacctatttgaattggttattacagaggccaggccagtctccaaaacgcctaatctatctgctgtctaaattggactctggagtccctgacaggttcagtgccagtggatcagggacagatttcacactgaaaatcagcagagtggaggctgaggatttgggagtttattactgcttgcagagtacacattttccgctcacgttcggtgctgggaccaagctggagatgaaa

SEQ ID NO: 625 - DNA, 336 bp, Artificial Sequence
  14H10.2C9 VL DNA sequence
gatgttgtgatgacccagactccactcactttgtcggttaccattggacaaccagcctccatctcttgcaagtcaagtcagagcctcttcgatagtgatggaaagacatatttgaattggttgttacagaggccaggccagtctccaaagcgcctaatctatctggtgtctaaactggactctggagtccctgacaggttcactggcagtggatcagggacagatttcacactgaaaatcagcagagtggaggctgaggatttgggagtttattattgctggcaaggtacacattttcctctcacgttcggtgctgggaccaagctggaaatgaaa

SEQ ID NO: 626 - DNA, 336 bp, Artificial Sequence
  15F10.2D6 VL DNA sequence
gatgttttgatgacccaaactccactctccctgcctgtcagtcttggagatcaagcctccatctcttgcagatctagtcagagcattgtacataataatggaaacacctatttagaatggtacctgcagaaaccaggccagtctccaaaactcctgatctacaaagtttccaaccgattttctggggtcccagacaggttcagtggcagtggatcagggacagatttcacactcaagatcagcagagtggaggctgaggatctgggagtttattactgctttcaaggttcacatgttccgctcacgttcggtggtgggaccaagttggagctgaaa

SEQ ID NO: 627 - DNA, 321 bp, Artificial Sequence
  19B5.2E6 VL DNA sequence
gatatacaaatgactcaaactacctcttctctttccgcatctttgggtgatcgggtcactatatcctgctccgcctctcaaggcataaacaattacctgaattggtatcagcaaaaaccagacggaactgtaaaattgcttatctactacgcttcaagtctgcatagtggggttcccagcagattttccggttccgggtccggcactgattattctctcacaattagtaacctggaacctgaggacattgcaacttattactgtcaacaatacagtcaggtaccttacactttcggatcaggaacaaagttggaaatcaag

SEQ ID NO: 628 - DNA, 321 bp, Artificial Sequence
  20D11.2C6 VL DNA sequence
gacatccagatgaaccagtctccatccagtctgtctgcatccctcggagacacaattaccatcacttgccgtgccagtcagaacatttatatttggttaagttggtaccagcagaaaccaggaaatattcctaaactcttgatctataaggcttccaacttgcacacaggcgtcccatcaaggtttagtggcagtggatctggaacagatttcacattaaccatcagcactctgcagcctgaagacattgccacttacttctgtctccagggtcaaagttatcctctcacgttcggtgctgggaccaagctggagatgaaa

SEQ ID NO: 629 - DNA, 321 bp, Artificial Sequence
  20H5.A3 VL DNA sequence
gatatccagatgacacagactacatcctccctgtctgcctctctgggagacagagtcaccatcaattgcagtgcaagtcaggacattagcaattatttaaactggtatcagcagaaaccagatggaactgttaaactcctgatctattacacatcaagtttactctcaggagtcccatcaaggttcagtggcagtgggtctgggacagattattctctcaccatcagcaacctggaacctgaagatattgccacttacttttgtcagcaatatagtaagcttccctatacgttcggatcggggacccacctggaaataaaa

SEQ ID NO: 630 - DNA, 321 bp, Artificial Sequence
  23H9.2E4 VL DNA sequence
gatatccagatgacacagactacatcctccctgtctgcctctctgggagacagagtcaccatcagttgcagtgcaagtcagggcattaacaattatttaaactggtatcagcagaaaccagatggaactgttaaactcctgatctattacgcatcaagtttacactcaggagtcccatcaaggttcagtggcagtgggtctgggacagattattctctcaccatcagcaacctggaacctgaagatattgccacttactattgtcagcagtatagtcaggttccgtatacgttcggatcggggaccaagttggaaataaaa

SEQ ID NO: 631 - DNA, 336 bp, Artificial Sequence
  2D10-VH0-VL0 VL DNA sequence
gacatagtaatgacacaggccgcatttagcaatccagtaaccttgggcacatccgcctccatatcttgcaggtcatccaaaagcttgctgcactctgacggtattacttacctgtactggtatttgcagcgacctgggcaatcccctcaactcctgatttaccgcatgagcaacctggcctcaggggtgcctgaccgcttttcaggatcagggagcggcactgacttcaccttgcgaatcagcagagtagaagcagaggatgttggagtttactactgtgcccagatgatcgaatttccacttacttttggggccgggaccattctggagcttaaa

SEQ ID NO: 632 - DNA, 336 bp, Artificial Sequence
  3B11.2G2 VL DNA sequence
gatgttgtgatgacccagactccactcactttgtcggttgccattggacaaccagcttccatctcttgcaagtcgagtcagagcctcttatatactaatggaaaaacctatttgaattggttattacagaggccaggccagtctccaaaacgcctaatctatctggtgtctaaattggactctggagtccctgacaggttcagtggcagtggatcagggacagatttcacactgaaaatcagcagagtggaggctgaggatttgggagtttattactgcttgcagagtacacattttccgctcacgttcggtgctgggaccaagctggagctgaaa

SEQ ID NO: 633 - DNA, 336 bp, Artificial Sequence
  7D8.2D8 VL DNA sequence
gatgttttgatgacccaaactccactctccctgcctgtcagtcttggagatcaagcctccatctcttgcagatctagtcagagcattgtacatagtaatggaaacacctatttagaatggtacctgcagaaaccaggccagtctccaaagctcctgatctacaaagtttccaaccgattttctggggtcccagacaggttcagtggcagtggatcagggacagatttcacactcaagatcagcagagtggaggctgaggatctgggagtttattactgctttcaaggttcacatgttccgctcacgttcggtgctgggaccaagctggagctgaaa

SEQ ID NO: 634 - DNA, 336 bp, Artificial Sequence
  mIMT001 VL DNA sequence
gatattgttattactcaggatgagcttagtaatcctgtcactagcggggaaagtgttagtatcagttgtcgttcatccaagtcactcctctacaaagacggcaagacttatctcaactggtttcttcaacgacccggtcaatctccacagctcctgatttacctgatgtcaactcacgcttctggtgttagcgaccgtttctccggaagtggctccgggacagacttcactcttgaaatctcacgtgtaaaagcagaggacgtaggtgtctattattgtcaacagcttgtggactaccccttgacctttggcgctggcacaaagctggaactgaag

SEQ ID NO: 635 - DNA, 336 bp, Artificial Sequence
  4A11.2B5 VL DNA sequence
gacattgtgatgactcaggcagccttttccaaccctgtaacacttggaactagtgcctccatctcatgccgttccagcaagagtcttttgcacagcgatgggataacctatctctattggtatctgcaacgacccggtcagtcaccccaacttcttatctatcgaatgtctaacttggcctccggcgtgcccgaccgcttttccgggagtgggagcggtacagatttcaccttgcgaatttcccgggttgaggcagaggacgtaggtgtctactattgtgctcagatgcttgagtttcctctcactttcggagccggcaccaaactggaactgaaa

SEQ ID NO: 636 - DNA, 336 bp, Artificial Sequence; identical to SEQ ID NO: 622
  4A11.H1L1 VL DNA sequence

SEQ ID NO: 637 - DNA, 336 bp, Artificial Sequence
  4A11.H4L2 VL DNA sequence
gatattgtaatgacccaaagccccctgtccttgcctgttaccccaggtgagcctgccagcatatcttgccgatccagtaaatctctgcttcatagcgatggcatcacctatttgtattggtatttgcagaagcccggccagagcccccagttgctgatctacagaatgtccaaccttgctagtggagtgcccgaccggtttagcggttcaggctcagggactgatttcactcttaaaatcagtagggtagaggccgaagacgttggtgtatattattgtgctcagatgttggagtttccactcacatttggacaaggtacaaagctggaaattaag

SEQ ID NO: 638 - DNA, 336 bp, Artificial Sequence
  4G2.2G6 VL DNA sequence
gatgtcgtaatgactcaaacccccctgacccttagtgttactataggccagcccgcaagcatctcctgcaaatcctcccagtctcttctttatactgatggcaaaacctacttgtcctggtttttgcagcgcccaggtcaaagtcctaaacgtcttatttacttggtctctaaactcgattccggcgtgcctgaccggttctccggtagcggtagcggtaccgatttcactttgaagattagccgagttgaggcagaagacctcggggtctactactgccttcagagtacacacttcccacttacatttggcgcaggaaccaagttggaggttaaa

SEQ ID NO: 639 - DNA, 321 bp, Artificial Sequence
  6B3.2D3 VL DNA sequence
agtattgtgatgacccagactcccaaattcctgcttgtatcagcaggagacagggttaccataacctgcaaggccagtcagagtgtgagtaatgatgtagcttggtaccaacagaagccagggcagtctcctaaattgttgatatattatgcatccaatcgctacactggagtccctgatcgcttcactggcagtggatatgggacggatttcactttcaccatcagcactgtgcaggctgaagacctggcagtttatttctgtcagcaggattatacctctccgtacacgttcggaggggggaccaagctggaaataaaa

SEQ ID NO: 640 - DNA, 321 bp, Artificial Sequence
  6H6.2D6 VL DNA sequence
gacatccagatgacccagaccacctcctccctgtccgcctccctgggcgacagggtgaccatctcctgctccgcctcccagggcatctccaactacctgaactggtaccagcagaagcccgacggcaccgtgaagctgctgatctactacacctcctccctgcactccggcgtgccctccaggttctccggctccggctccggcaccgactactccctgaccatctccaacctggagcccgaggacatcgccacctactactgccagcagtactccgagctgccctacaccttcggctccggcaccaagctggagatcaag

SEQ ID NO: 641 - DNA, 321 bp, Artificial Sequence
  9H2.2H10 VL DNA sequence
gacattgtgatgacccagtctcacaaattcatgtccacatcagtaggagacagggtcagcatcacctgcaaggccagtcaggatgtgagtactgctgtagcctggtatcaacaaaaaccagggcaatctcctaaactactgatttactgggcatccacccggcacactggagtccctgatcgcttcacaggcagtggatctgggacagattatactctcaccatcagcagtgtgcaggctgaagacctggcactttattactgtcagcaacattataccactccgctcacgttcggtgctgggaccaagctggagctgaaa

SEQ ID NO: 642 - DNA, 321 bp, Artificial Sequence
  13G4.2F8 VL DNA sequence
gacattgtgatgacccagtctcaaaaattcatgtccacatcagtaggagagagggtcagcatcacctgcaaggccagtcagaatgtaggtactaatgtagcctggtatcagcagaaagcagggcagtctcttgaactgctgatctatggggcatccaaccggcacactggagtccctgatcgcttcacaggcagtggatctgggacagatttcactctcaccatcaccaatgtgcagtctgaagacatgacaaattatttctgtgagcaatatagcaactttcctctcacgttcggtgctgggaccaagctggagctgaaa

SEQ ID NO: 643 - DNA, 336 bp, Artificial Sequence
  13H12.2F8 VL DNA sequence
gacgttgttatgacacaaacaccacttacactttctgtaactatcggtcagcctgcctcaatttcatgtaagtcttctcagtccctgtttcatagcgacgggaagacttacctgaattggcttctccaacgaccaggccaatcacccaagcgccttatttatttggtcagtaaattggacagtggagttcccgatagatttaccgggagcggttctgggaccgatttcaccccaaagatctccagggtagaagacgaagatctcggtgtgtactattgctggcaggggacacatttccctctgacattcggtgctggaaccaaacttgagatgaaa

SEQ ID NO: 644 - DNA, 321 bp, Artificial Sequence
  15G7.2A7 VL DNA sequence
gacatccagatgaaccagtctccatccagtctgtctgcatccctcggagacacaatttccatcacttgccgtgccagtcagaacattaatatttggttaagctggtaccagcagaaaccaggaaatattcctcaactattgatctataaggcttccaacttgcacacaggcgtcccctcaaggtttagtggcagtggatctggaacagatttcacattaaccatcagcagtctgcagcctgaagacattgccacttactactgtctacagggtcaaagttatcctctcacgttcggtgctgggaccaagctggtgatgaaa

SEQ ID NO: 645 - DNA, 330 bp, Artificial Sequence
  19D9.2E5 VL DNA sequence
gatgttgtgatgacccagactccactcactttgtcggttaccattggacaaccagcctccatctcttgtaagtcaagtcagagcctcttacatagtgatggaaagacatatttgaattggttgttacagaggccaggccagcctccaaagcgcctaatgtatctggtgtctacactggactctggagtccctgacaggttcactggcagtggatcagggacagatttcacactgaaaatcagcagagtggaggctgaggatttgggagtttattattgctggcaaggtacacattttcctctcacgttcggtgctgggaccaagccggag

SEQ ID NO: 646 - DNA, 330 bp, Artificial Sequence
  23B10.2B12 VL DNA sequence
gatattgtgatgacgcaggctgcattctccaatccagtcactcttggaacgtcagcttccatctcctgcaggtctagtaagagtctcctacatagtgatggcatcacttatttctattggtatctgcagaggccaggccagtctcctcagctcctgatatatcggatgtccaaccttgcctcaggagtcccagacaggttcagtggcagtgggtcaggaactgatttcacactgagaatcagcagagtggaggctgaggatgtgggtgtttattactgtgctcaaatgctagaattcccgctcacgttcggtgctgggaccaagctggag

SEQ ID NO: 647 - DNA, 321 bp, Artificial Sequence
  24D12.2H9 VL DNA sequence
gacattgtgatgacccagtctcacaaattcatgtccacatcagtaggagacagggtcagcatcacctgcaaggccagtcaggatgtgcgtactgctgtagcctggtatcaacagaaaccagggcaatctcctaaactactgatttactgggcatccacccggcacactggagtccctgatcgcttcacaggcagtggatctgggacagatttcactctcacccttagcaatgtgcagtctgaagacttggcagattatttctgtcagcaatatagtagttatccgtggacgttcggtggaggcaccaagctggaaatcaaa

SEQ ID NO: 648 - DNA, 336 bp, Artificial Sequence
  F846C.1B2 VL DNA sequence
aacatttggttgacacagtcgccatcatctctggctgtgtctgcaggagaaatggtcactatgacctgtaagtccagtcaaagtgttttatacagttcaaatcagaagaactacttggcctggtaccagcagaaaccagggcagtctcctaaactgctgatctactgggcatccactagggaatctggtgtccctgatcgcttcacaggcagtggatctgggacagacttttctcttaccatcagcagtgtacaagctgaagacctggcagtttattactgtcatcaatatctctcctcgctcacgttcggtgctgggaccaagctggagctgaaa

SEQ ID NO: 649 - DNA, 336 bp, Artificial Sequence
  F846C.1F5 VL DNA sequence
aacattatgatgacacagtcgccatcatctctggctgtgtctgcaggagaaaaggtcactatgagctgtaagtccagtcaaagtgttttatacagttcaaatcagaagaactacttggcctggtaccagcagaaaccagggcagtctcctaaactgctgatctactgggcatccactagggaatctggtgtccctgatcgcttcacaggcagtggatctgggacagattttactcttaccatcagcagtgtacaacctgaagacctggcagtttattactgtcatcaatacctctcctcgctcacgttcggtgctgggaccaagctggagctgaaa

SEQ ID NO: 650 - DNA, 336 bp, Artificial Sequence
  F846C.1H12 VL DNA sequence
aacattatgatgacacagtcgccatcatctctggctgtgtctgcaggacaaaaggtcactatgagctgtaagtccagtcaaagtgttttatacagttcaagtcagaagaactacttggcctggtaccagcagaaaccagggcagtctcctaaacttctgatctactgggcatccactagggaatctggtgtccctgatcgcttctcaggcagtggatctgggacagattttactcttaccatcagcagtgtacaacctgaagacctggcagtttattactgtcatcaatacctctcctcgctcacgttcggtgctgggaccaagctggagctgaaa

SEQ ID NO: 651 - DNA, 336 bp, Artificial Sequence
  F846C.1H5 VL DNA sequence
gatgttgtgatgacccaaactccactctccctgcctgtcagtcttggagatcaagcctccatctcttgcagatctagtcagagccttgtacacaatagtggaaacacctatttacattggtacctgcagaggccaggccagtctccaaacctcctgatctacaaagtttccaaccgattttctggggtcccagacaggttcagtggcagtggatcagggacagatttcacactcaagatcagcagagtggcggctgaggatctgggagtttatttctgctctcaaagtacacatgttcctccgacgttcggtggaggcaccaagctggaaatcaaa

SEQ ID NO: 652 - DNA, 336 bp, Artificial Sequence; identical to SEQ ID NO: 649
  F846C.2H3 VL DNA sequence

SEQ ID NO: 653 - DNA, 327 bp, Artificial Sequence
  F846TC.14A2 VL DNA sequence
caggctgttgtgactcaggaatctgcactcaccacatcacctggtgaaacagtcacactcacttgtcgctcaagtactggggctgttacaactagtaactatgccaactgggtccaagaaaaaccagatcatttattcactggtctaataggtggtatcaataaccgagttccaggtgttcctgccagattctcaggctccctgattggagacaaggcagccctcaccatcacaggggcacagactgaggatgaggcaatatatttctgtgctctatggtatagcaaccattgggtgttcggtggaggaaccaaactgactgtccta

SEQ ID NO: 654 - DNA, 336 bp, Artificial Sequence
  F846TC.14E4 VL DNA sequence
gatattgtgatgacgcaggctgcattctccaatccagtcactcttggaacatcagcttccatctcctgcaggtctagtaagagtctcctacatactaatggcatcacttttttgtattggtatctgcagaagccaggccagtctcctcagcccctgatttatcagatgtccaaccttgcctcaggagtcccagacaggttcagtagcagtgggtcaggaactgatttcacactgagaatcagcagagtggaggctgaggatgtgggtgtttattactgtgctcaaaatctagaacttccttggacgttcggtggaggcaccaagctggaaatcaat

SEQ ID NO: 655 - DNA, 336 bp, Artificial Sequence
  F846TC.16B5 VL DNA sequence
aacattatgatgacacagtcgccatcatctctggctgtgtctgcaggagaaaaggtcactatgagctgtaagtccagtcaaagtgttttatacagttcaaatcagaagaactacttggcctggtaccagcagaaaccagggcagtctcctaaactactgatctactgggcatccactagggaatctggtgtccctgatcgcttcacaggcagtggatctgggacagattttactcttaccatcagcagtgtacaagctgaagacctggcagtttattactgtcatcaatacctctcctcgctcacgttcggtgctgggaccaagctggagctgaaa

SEQ ID NO: 656 - DNA, 339 bp, Artificial Sequence
  F846TC.7F10 VL DNA sequence
gacattgtgatgacacagtctccatcctccctggctatgtcagtaggacagaaggtcactatgagctgcaagtccagtcagagccttttaaatagtagcaatcaaaagaactatttggcctggtaccagcagaaaccaggacagtctcctaaacttctggtatactttgcatccactagggaatctggggtccctgatcgcttcataggcagtggatctgggacagatttcactcttaccatcagcagtgtgcaggctgaagacctggcagattacttctgtcagcaacattatagcactccgtacacgttcggagggggggccaagctggaaataaaa

SEQ ID NO: 657 - DNA, 321 bp, Artificial Sequence
  F847C.10B9 VL DNA sequence
gacatccggatgactcagtctccatccagtctgtctgcatcccttggagacacaattaccatcacttgccatgccagtcagaacattaatgtttggttaagctggtaccagcagaaaccaggaaatattcctaaactattgatctataaggcttccaacttgcacacaggcgtcccatcaaggtttagtggcagtggatctggaacaggtttcacattaaccatcagcagcctgcagcctgaagacattgccacttactactgtcaacagggtcaaagttatccgtacacgttcggaggggggaccaagctggagctgaaa

SEQ ID NO: 658 - DNA, 321 bp, Artificial Sequence
  F847C.11B1 VL DNA sequence
gaaattgtgttgacccagtctccagcatccctgtccgtgactacaggagaaaaagtcactatcagatgcataaccagcattgatattgatgatgatatgaactggtaccagcagaagccaggggaacctcctaagctccttatttcagaaggcaatactcttcgtcctggagtcccatcccgattctccagcagtggctatggcacagattttgtttttacaattgaaaacacgctctcagaagatgttgcagattactactgtttgcaaagtgataacaagcctctcacgttcggtgctgggaccaagctggagctgaaa

SEQ ID NO: 659 - DNA, 321 bp, Artificial Sequence
  F847C.12F12 VL DNA sequence
gacatccaggtgattcagtctccatccagtctgtctgcatcccttggagacacaattaccatcacttgccatgccagtcagaacattaatgtttggttaagctggtaccagcagaaaccaggaaatattcctaaactattgatctataaggcttccaacttgcacacaggcgtcccatcaaggtttagtggcagtggatctggaacaggtttcacattaaccatcagcagcctgcagcctgaagacattgccacttactactgtcaacagggtcaaagttatccgtacacgttcggaggggggaccaagctggagctgaaa

SEQ ID NO: 660 - DNA, 321 bp, Artificial Sequence
  F847C.26F5 VL DNA sequence
gaaattaagatgaaccagtctccatccagtctgtctgcatcccttggagacacaattaccatcacttgccatgccagtcagaacattaatgtttggttaagctggtaccagcagaaaccaggaaatattcctaaactattgatctataaggcttccaacttgcacacaggcgtcccatcaaggtttagtggcagtggatctggaacaggtttcacattaaccatcagcagcctacagcctgaagacattgccacttactactgtcaacagggtcaaagttatccgtacacgttcggaggggggaccaagctggagctgaaa

SEQ ID NO: 661 - DNA, 327 bp, Artificial Sequence
  F847C.4B10 VL DNA sequence
caggctgttgtgactcaggaatctgcactcaccacatcacctggtgaaacagtcacactcacttgtcgctcaagtactggggctgttacaactagtaactatgccaactgggtccaagaaaaaccagatcatttattcactggtctaataggtggtaccaacaaccgagctccaggtgttcctgccagattctcaggctccctgattggagacaaggctgccctcaccatcacaggggcacagactgaggatgaggcaatatatttctgtgctctatggtacagcaaccatttagtgttcggtggaggaaccaaactgactgtccta

SEQ ID NO: 662 - DNA, 336 bp, Artificial Sequence
  F849C.8D10 VL DNA sequence
gatgttttgatgacccaaactccactctccctgcctgtcagtcttggagatcaagcctccatctcttgcagatctagtcaggacattgtgcatagtagtggaaacacctatttagaatggtacctgcagaaaccaggccagtctctaaagctcctgatttacaaagtttccaaccgattttctggggtcccagacaggttcagtgccagtggatcagggacagatttcacactcaagatcagcagagtggaggctgaggatctgggagtttattactgctttcaaggttcacatgttcctcccacgttcggctcggggacaaagttggaaataaaa

SEQ ID NO: 663 - DNA, 336 bp, Artificial Sequence
  F849C.8H3 VL DNA sequence
gatattgggatgaggcaggctgcattctccaatccagtcactcttggaacatcagcttccatctcctgcaggtctagtaagagtctcctatatagtaatggcatcacttatttgtattggtttctccagaagccaggccagtctcctcagctcctgatttatcagatgtccaaccttgcctcaggagtcccagacaggttcagtagcagtgggtcaggaactgatttcacactgagaatcagcagagtggaggctgacgatgtgggtgtttattactgtgctcaaaatctagaacttccgtggacgttcggtggaggcaccaagctggaaatcaaa

SEQ ID NO: 664 - DNA, 333 bp, Artificial Sequence
  846.2B11 VL DNA sequence
gacattgtgctgacacagtctcctgcttccttaggtgtttctctggggcagagggccaccatctcatgcagggccagcaaaagtgtcagtacatctggctatagttatatgcactggtaccaacagaaaccaggacagccacccaaactcctcatctatcttgcatccatcctagaatctggggtccctgccaggttcagtggcagtgggtctgggacagacttcaccctcaacatccatcctgtggaggaggaggatgctgcaatctattactgtcagcacagtagggagcttcctctcacgttcggtgctgggaccaagctggagctgaaa

SEQ ID NO: 665 - DNA, 333 bp, Artificial Sequence
  846.4D5 VL DNA sequence
aacattgtgctgacccaatctccagcttctttggctgtgtctctagggcagagggccaccatatcctgcagagccagtgaaagtgttgatagttatggcaatagttttatgcactggtaccagcagaaaccaggacagccacccaaactcctcatctatcttgcatccaacctagaatctggggtccctgccaggttcagtggcagtgggtctaggacagacttcaccctcaccattgatcctgtggaggctgatgatgctgcaacctattactgtcagcaaaataatgaggatccgtggacgttcggtggaggcaccaagctggaaatcaaa

SEQ ID NO: 666 - DNA, 336 bp, Artificial Sequence
  846T.1H2 VL DNA sequence
gatgttgtgatgacccagactccactcactttgtcggttaccattggacaaccagcctctatctcttgcaagtcaagtcagagtctcttatatagtaatggaaaaacctatttgaattggttattacagaggccaggccagtctccaaagcgcctaatctatctggtgtctaaactggactctggagtccctgacaggttcactggcagtggatcaggaacagattttacactgaaaatcagcagagtggaggctgaggatttgggagtttattactgcgtgcaaggtacacattttcctcagacgttcggtggaggcaccaagctggaaataaaa

SEQ ID NO: 667 - DNA, 327 bp, Artificial Sequence; identical to SEQ ID NO: 661
  847.14H4 VL DNA sequence

SEQ ID NO: 668 - DNA, 333 bp, Artificial Sequence
  846.2D4 VL DNA sequence
aacattgtgctcacccaatctccagcttctttggctgtgtctctagggcagagggccaccatatcctgcagagccagtgaaagtgttgatagttatggcaatagttttatgcactggtaccagcagaaaccaggacagccacccaaactcctcatctatcttgcatccaacctagaatctggggtccctgccaggttcagtggcagtgggtctaggacagacttcaccctcaccattgatcctgtggaggctgatgatgctgcaacctattactgtcagcaaaataatgaggatccgtggacgttcggtggaggcaccaagctggaaataaaa

SEQ ID NO: 669 - DNA, 321 bp, Artificial Sequence
  846.2F11 VL DNA sequence
gacatcctgatgacccaatctccatcctccatgtctgtatctctgggagacacagtcagcatcacttgccatgcaagtcagggcattaacagtaatatagggtggttgcagcagaaaccagggaagtcatttaagggcctgatctatcatggaaccaacttggaagatggagttccatcaaggttcagtggcagtggatctggagcagattattctctcaccatcagcagcctggaatctgaagattttgcggactattactgtgtacagtatgatcagtttccgtggacgttcggtggaggcaccaagctggaaatcaaa

SEQ ID NO: 670 - DNA, 333 bp, Artificial Sequence
  846T.10B1 VL DNA sequence
gacattgtgatgtcacagtctcctgcttccttaggtgtttctctggggcagagggccaccatctcatgcagggccagcaaaagtgtcagtacatctggctatagttatatgcactggtaccaacagaaaccaggacagccacccaaactcctcatctatcttgcatccatcctagaatctggggtccctgccaggttcagtggcagtgggtctgggacagacttcaccctcaacatccatcctgtggaggaggaggatgctgcaatctattactgtcagcacagtagggagcttcctctcacgttcggtgctgggaccaagctggagctgaaa

SEQ ID NO: 671 - DNA, 333 bp, Artificial Sequence
  846T.2E3 VL DNA sequence
gacattgtgctgacacagtctcctgcttccttagctgtatctctggggcagagggccaccatctcatgcagggccagcaaaagtgtcagtacatctggctatagttatatgcactggtaccaacagaaaccaggacagccacccaaactcctcatctatcttgcatccatcctagaatctggggtccctgccaggttcagtggcagtgggtctgggacagacttcaccctcaacatccatcctgtggaggaggaggatgctgcaacctattactgtcagcacagtagggagcttcctctcacgttcggtgctgggaccaagctggagctgaaa

SEQ ID NO: 672 - DNA, 321 bp, Artificial Sequence
  846T.4C9 VL DNA sequence
gacattttgatgacccaaactccatcctccatgtctgtatctctgggagacacagtcagcatcacttgccatgcaagtcagggcattagcagtaatatagggtggttgcagcagaaaccacggaaatcatttaagggcctgatctattatggaaccaacttggaagatggagttccatcaaggttcagtggcagtggatctggagcagattattctctcaccatcagcagcctggaatctgaagattttgcagactattactgtgtacagtatgatcagtttccgtggacgttcggtggaggcaccaagctggaaataaaa

SEQ ID NO: 673 - DNA, 333 bp, Artificial Sequence
  846T.4E11 VL DNA sequence
gacattgtgctgacacagtctcctgcttccttagctgtatctctggggcagagggccaccatctcatgcagggccagcaaaagtgtcagtacatctggctatagttgtatgcactggtaccaacagaaaccaggacagccacccaaactcctcatctatcttgcatccaacctagaatctggggtccctgccaggttcagtggcggtgggtctgggacagacttcaccctcagcatccatcctgtggaggaggaggatgctgcaacctattactgtcaccacagtacggagcttccgtacacgttcggaggggggaccaagctggaagtagaa

SEQ ID NO: 674 - DNA, 333 bp, Artificial Sequence
  846T.4F5 VL DNA sequence
gacattgtgctgacccaatctccagcttctttggctgtgtctctagggcagagggccaccatatcctgcagagccagtgaaagtgttgatagttatggcaatagttttatgcactggtaccagcagaaaccaggacagccacccaaactcctcatctatcttgcatccaacctagaatctggggtccctgccaggttcagtggcagtgggtctaggacagacttcaccctcaccattgatcctgtggaggctgatgatgctgcaacctattactgtcagcaaaataatgaggatccgtggacgttcggtggaggcaccaagctggaaatcaaa

SEQ ID NO: 675 - DNA, 324 bp, Artificial Sequence
  846T.8D1 VL DNA sequence
gacattgtgctgacacagtctcctgcttccttagctgtatctctggggcagagggccaccatctcatgcagggccagcaaaagtgtcagtacatctggctatagttatatgcactggtaccaacagaaaccaggacagccacccaaactcctcatctatcttgcatccatcctagaatctggggtccctgccaggttcagtggcagtgggtctgggacagacttcaccctcaacatccatcctgtggaggaggaggatgctgcaacctattactgtcagcacagtagggagcttcctctcacgttcggtgctgggaccaagctg

SEQ ID NO: 676 - DNA, 333 bp, Artificial Sequence
  847.10C9 VL DNA sequence
gatgttgtgatgacccagactccactcactttgtcggttaccattggacaaccagcctctatctcttgcaagtcaagtcagagcctcttatatagtgatggaaaaacctatttgaattggttattacagaggccaggccagtctccaaagcgcctaatctatctggtgtctcaactggactctggagtccctgacaggttcactggcagtggatcaggaacagattttacactgaaaatcagcagagtggaggctgatgatttgggagtttattgctgcgtgcaaggtacacatcttcccacgttcggaggggggaccaagctggaaataaaa

SEQ ID NO: 677 - DNA, 333 bp, Artificial Sequence
  847.11D6 VL DNA sequence
gacattgtgatgacacagtctcccgcttctttggctgtgtctctagggcagagggccaccatatcctgcagagccagtgaaagtgttgaaaatcatgtcaatagttttatgcactggttccaacagaaaccaggacagccacccaaactcctcatctatcgtgcatccaacctacaatctgggatccctgccaggttcagtggcagtgggtctaggacagacttcaccctcaccattaatcctgtggaggctgatgatgttgcaacctattactgtcagcaaaataatgaggtcccgtacacgttcggaggggggaccaagctggaaataaaa

SEQ ID NO: 678 - DNA, 327 bp, Artificial Sequence
  847.15D12 VL DNA sequence
caggctgttgtgactcaggaatctgcactcaccacatcacctggtgaaacagtcacactcacttgtcgctcaagtactggggctgttacaactagtaactatgccaactgggtccaagaaaaaccagatcatttattcactggtctaataggtggtaccaacaaccgagctccaggtgttcctgccagattctcaggctccctgattggagacaaggctgccctcaccatcacaggggcacagactgaggatgaggcaatatatttctgtgctctatggtacagcaaccatttggtgttcggtggaggaaccaaactgactgtccta

SEQ ID NO: 679 - DNA, 318 bp, Artificial Sequence
  847.15F9 VL DNA sequence
caaattgttctctcccagtctccagcaatcctgtctgcatctccaggggagaaggtcacaatgacttgcagggccagctcaagtgtaacttacatgtactggtaccagcagaagccaggatcctccccccaaccctggatttatgccacatccaacctggcttctggagtccctgctcgcttcagtggcagtgggtctgggacctcttactctctcacaatcagcagagtggaggctgaagatgctgccacttattactgccagcagtggagtagtaacccactcacgttcggtgctgggaccaagctggagctgaaa

SEQ ID NO: 680 - DNA, 333 bp, Artificial Sequence
  847.15H11 VL DNA sequence
gacattgtgctaacacagtctccagcttctttggctgtgtctctagggcagagggccaccatctcctgcagagccagcgaaagtcttgataattctggcattagttttatgaactggttccaacagagaccaggacagccacccaaactcctcatctatgctgcatccaacctagaatccggggtccctgccaggtttagtggcagtgggtctgggacagacttcagcctcaacatccatcctatggaggaggatgatgctgcaatgtatttctgtcagcacagtaaggaggttccgtggacgttcggtggaggcaccaagctggaaatcaaa

SEQ ID NO: 681 - DNA, 321 bp, Artificial Sequence
  847.20H7 VL DNA sequence
gacattgtgatgacccagtctcacaaaatcatgtccacatcagtaggagacagggtcagcatcacctgcaaggccagtcaggatgtgagtaccactgtggcctggtttcagcaaaaaccaggacaatctcctaaactactgctttactgggcatccacccggcacactggagtccctgatcgcttcacaggcagtggatctgggacagattatactctcaccatcagcagtgtccaggctgaagacctggcactttattactgtcagcaacattatagccctccattcacgttcggctcggggaccaagctggaaataaaa

SEQ ID NO: 682 - DNA, 321 bp, Artificial Sequence
  847.21B11 VL DNA sequence
gacattgtgatgactcagtctcaaaaattcatgtccacatcagtaggagacagggtcagcgtcacctgcaaggccagtcagaatgtgggtattaatgtagcctggtatcaacagaaaccagggcaatctcctaaagcactgatttactcggcatcctaccggtacagtggagtccctgatcgcttcacaggcagtggatctgggacagatttcactctcaccatcagcaatgtgcagtctgaagacttggcagagtatttctgtcagcaatataatagttatccgtacacgttcggaggggggaccaagctggaaatgaaa

SEQ ID NO: 683 - DNA, 336 bp, Artificial Sequence
  847.27B9 VL DNA sequence
gacgttgtgatgacccagactccactcactttgtcggttacccttggacaacccgcctccatctcttgcaggtcaagtcagagcctcttagatagtgatggaaagacatatttgaattggttgttacagaggccaggccagtctccaaagcgcctaatctatttggtgtctagactggactctggagtccctgacaggttcactggcagtggatcagggacagatttcacactgaaaatcagcagagtggaggctgaggatctgggagtttattattgctggcaaggtacacattttccgttcacgttcggaggggggaccaagctggaaataaaa

SEQ ID NO: 684 - DNA, 321 bp, Artificial Sequence
  847.28D1 VL DNA sequence
gacatccggatgactcagtctccagcctccctatctgcatctgtgggagaaactgtcaccatcacatgtcgagcaagtgggaatattcacaattatttagcatggtatcatcagaaacagggaaaatctcctcagctcctggtctataatgtaaaaaccttagcagatggtgtgccatcaaggttcagtggcagtggatcaggaacacaattttctctcaagatcaacagtttgcagcctgaagattttgggacttattattgtcaacatttttggagtatttttccgacgttcggtggaggcaccaagctggaaataaaa

SEQ ID NO: 685 - DNA, 318 bp, Artificial Sequence
  847.2B8 VL DNA sequence
caaattcttctctcccagtctccagcaatcctgtctgcatctccaggggagaaggtcacaatgacttgcagggccagctcaagtgtaacttacatgtactggtaccagcagaagccaggatcctccccccaaccctggatttatgccacatccaacctggcttctggagtccctgctcgcttcagtggcagtgggtctgggacctcttactctctcacaatcagcagagtggaggctgaagatgctgccacttattactgccagcagtggagtagtaacccactcacgttcggtgctgggaccaagctggagctgaaa

SEQ ID NO: 686 - DNA, 315 bp, Artificial Sequence
  847.3B3 VL DNA sequence
gacattttgatgactcagtctccagcctccctatctgcatctgtgggagaaactgtcaccatcacatgtcgagcaagtgggaatattcacaattatttagcatggtatcagcagaaacagggaaaatctcctcaactcctggtctatagtgcaaaaaccttagcagatggtgtgccatcaaggttcagtggcagtggatcaggaacacaattttctctcaagatcgacagcctgcagcctgaagattttgggacttattactgtcaacatttttggagtctttttccgacgttcggtggaggcaccaagctggaa

SEQ ID NO: 687 - DNA, 321 bp, Artificial Sequence
  849.1D2 VL DNA sequence
gacgttgtgatgacccagactcccaaattcctgcttgtatcagcaggagacagggttaccataacctgcaaggccagtcaaagtgtgagtagtgatgtagcttggtaccaacagaagccagggcagtctcctaaactgctgatatactttgcatccaatcgctacactggagtccctgatcgcttcactggcagtggatatgggacggatttcactttcaccatcagcactgtccaggctgaagacctggcagtttatttctgtcagcataattatatctctccgttcacgttcggaggggggaccaagctggaaataaaa

SEQ ID NO: 688 - DNA, 321 bp, Artificial Sequence
  849.2D7 VL DNA sequence
gacattgtgatgacccagtctcacaaattcatgtccacatcagtaggagacagggtcagcatcacctgcaaggccagtcaggatgtgagtactgctgtagcctggtatcaacaaaaaccagggcaatctcctaaactactgatttactgggcatccacccggcacactggagtccctgatcgcttcacaggcagtggatctgggacagattatactctcaccatcagcagtgtgcaggctgaagacctggcactttattactgtcagcaacattatagcactccgtacacgttcggaggggggaccaagctggaaataaaa

SEQ ID NO: 689 - DNA, 321 bp, Artificial Sequence
  849.2F12 VL DNA sequence
gacattgcgatgacccagtctcacaaattcatgtccacatcagtaggagacagggtcagcatcacctgcaaggccagtcaggatgtgagtactgctgtagcctggtatcaacaaaaaccagggcaatctcctaaactactgatttactgggcatccacccggcacactggagtccctgatcgcttcacaggcagtggatctgggacagattatactctcaccatcagcagtgtgcaggctgaagacctggcactttattactgtcagcaacattataacactccgtacacgttcggaggggggaccaagctggaaataaaa

SEQ ID NO: 690 - DNA, 336 bp, Artificial Sequence
  849.4B2 VL DNA sequence
gatgtggggatgacccagactccactcattttgtcggttaccattggacaaccagcttccatctcttgcaagtcaagtcagagcctcttatatattaatggaaaaacctatttgaattggttattacagaggccaggccagtctccaaaacgcctaatctatctggtgtctaaattggactctggagtccctaacagattcagtggcagtggatcagggacagatttcacactgaaaatcagcagagtggaggctgaggatttgggagtttattactgcttgcagagtacacattttcctcagacgttcggtggaggcaccaagctggaaatcaaa

SEQ ID NO: 691 - DNA, 321 bp, Artificial Sequence
  849.4F12 VL DNA sequence
gacatcctgctgacccagtctccatcctccatgtctgtatctctgggagacacagtcagcatcacttgccatgcaagtcagggcattaacagtaatatagggtggttgcagcagaaaccagggaagtcatttaagggcctgatctatcatggaaccaacttggaagatggagttccatcaaggttcagtggcagtggatctggagcagattattctctcaccatcagcagcctggaatctgaagattttgcggactattactgtgtacagtatgatcagtttccgtggacgttcggtggaggcaccaagctggaaatcaaa

SEQ ID NO: 692 - DNA, 336 bp, Artificial Sequence
  849.4F2 VL DNA sequence
gatgttgggatgacccagactccactcattttgtcggttaccattggacaaccagcttccatctcttgcaagtcaagtcagagcctcttatatattaatggaaaaacctatttgaattggttattacagaggccaggccagtctccaaaacgcctaatctatctggtgtctaaattggactctggagtccctaacagattcagtggcagtggatcagggacagatttcacactgaaaatcagcagagtggaggctgaggatttgggagtttattactgcttgcagagtacacattttcctcagacgttcggtggaggcaccaagctggaaatcaaa

SEQ ID NO: 693 - DNA, 336 bp, Artificial Sequence
  849.5C2 VL DNA sequence
gatattgtgatgactcaggctgcaccctctgtacctgtcactcctggagagtcagtatccatctcctgcaggtctagtaggagtctcctgcatagtaatggctacacttacttgtattggttcctgcagaggccaggccagtctcctcggctcctgatatatcggatgtccaaccttgcctcaggagtcccagacaggttcagtggcagtgggtcaggaactgctttcacactgagaatcagtagagtggaggctgaggatgtgggtgtttattactgtatgcaacatctagaatatccgtacacgttcggaggggggaccaagctggaaataaaa

SEQ ID NO: 694 - DNA, 318 bp, Artificial Sequence
  849.8D12 VL DNA sequence
gacatccagatgacacagactacatcctccctgtctgcctctctgggagacagagtcaccatcagttgcagtgcaagtcagggcattagcaattatttaaactggtatcagcagaaaccagatggaactgttaaactcctgatctattacacatcaagtttacactcaggagtcccatcaaggttcagtggcagtgggtctgggacagattattctctcaccatcagcaacctggaacctgaagatattgccacttactattgtcagcagtatagtaagcttcctcggacgttcggtggaggcaccaagctggaaatc

SEQ ID NO: 695 - DNA, 336 bp, Artificial Sequence
  F847C.21H6 VL DNA sequence
gatgttgtgatgacccagactccactcactttgtcggttaccattggacaaccagcctccatctcttgcaagtcaagtcggagcctcttagatagtgatggaaagacatatttgaattggttgttacagaggccaggccagtctccaaagcgcctaatctatctggtgtccaaactggactctggagtccctgacaggttcactggcagtggatcagggacagatttcacactgaaaatcagcagagtggaggctgaggatttgggagtttattattgctggcaaggtacacattttcctcagacgttcggtggaggcaccaagctggaaatcaat

SEQ ID NO: 696 - DNA, 321 bp, Artificial Sequence
  849.5H1 VL DNA sequence
gacatccagatgaaccagtctccatccagtctgtctgcatcccttggagacacaattaccatcacttgccatgccagtcagaacattaatgtttggttaagctggtaccagcagaaaccaggaaatattcctaaactattgatctatcaggcttccaacttacacacaggcgtcccatcaaggtttagtggccgtggatctggaacaggtttcacattaaccatcagcagcctgcagcctgaagacattgccacttactactgtcaacagggtcaaagttctccattcacgttcggctcggggacaaagttggaaataaaa

SEQ ID NO: 697 - DNA, 321 bp, Artificial Sequence
  847.23F11 VL DNA sequence
gacattttgatgacccagtctcacaaattcatgtccacatcagtaggagacagggtcagcatcacctgcaaggccagtcaggatgtgagttctgttgtagtctggtatcaacaaaaaccaggacaatctcctaaacaactaatttactgggcatccacccggcacactggagtccctgatcgcttcacaggcagtggatctgggacagattatactctcaccatcagcagtgtgcaggctgaagacctggcactttattactgtcagcaacattatagcacgccgtacacgttcggaggggggaccaagctggaaataaaa

SEQ ID NO: 698 - DNA, 327 bp, Artificial Sequence
  847.16D10 VL DNA sequence
caggctgttgtgactcaggaatctgcactcaccacatcacctggtgaaacagtcacactcacttgtcgctcaagtactggggctgttacaactagtaactatgccaactgggaccaagaaaaaccagatcatttattcactggtctaataggtggtaccaacaaccgagctccaggtgttcctgccagattctcaggctccctgattggagacaaggctgccctcaccatcacaggggcacagactgaggatgaggcaatatatttctgtgctctatggtacagcaaccatttggtgttcggtggaggaaccaaggtcactgtccta

SEQ ID NO: 699 - DNA, 333 bp, Artificial Sequence
  847.13E2-mH0mL1 VL DNA sequence
gacattgtgatgacacagtctcctgcttccttacctgtatctctggggcagagggccaccatctcatgcagggccagcaaaagtgtcactacatctgcctatagttatatacactggtaccaacagagaccaggacagccacccaaactcctcatctatcttgcatccaacctagaatctggggtccctgccaggttcagtggcagtgggtctgggacagacttcaccctcaacatccatcctgtggaggaggaggatgctgcaacctattactgtcagcacaatagggagcttcctccgacgttcggtggaggcaccaagctggaaatcaat

SEQ ID NO: 700 - DNA, 321 bp, Artificial Sequence
  847.13E2-mH0mL2 VL DNA sequence
gatattgtgctaactcagtctccagccaccctgtctgtgactccaggagatagcgtcagtttttcctgcagggccagccaaattattaacaacaacctacactggtatcaacaaaaatcacatgagtctcctaggcttctcatcaggtatacttcccagtccatctctgggatcccctccaggttcagtggcagtggatcagggacagatttcactctcagtatcaacaatgtggagactgaagattttggaatgtatttctgtcaacagactaacagctggcctctcacgttcggtgctgggaccaagctggagctgaaa

SEQ ID NO: 701 - DNA, 333 bp, Artificial Sequence
  847.12C4 VL DNA sequence
gatgttgtgatgacccagactccactcactttgtcggttaccattgaacaaacagcctccatctcttgcaagtcaagtcagagcctcttagatcgtgatggaaagacatatttgaattggttgttacagaggccaggccagtctccaaagcgcctaatctatctggtgtctaaactggactctggagtccctgacaggttcactggcagtggatcagggacagatttcacactgaaaatcagcagagtggaggctgaggatttgggagtttattattgctggcaaggtacacattttccgacgttcggtggaggcaccaagctggaaatcaaa

SEQ ID NO: 702 - DNA, 321 bp, Artificial Sequence
  847.4D3 VL DNA sequence
gatgttgtgatgacccaaactcccaaattcctgcctataacagcagaagacagggttaccattacctgcaaggccagtcagagtgtgagtaatgaagtagcttggtaccaacagaagccagggcagtctcctaaactgctgatatactatgcatccaatcgctacactggagtccctgatcgcttcactggcagtggatctggcacggatttcactttcaccatcagaagtgtgcaacttgaagacctggcagtttatttctgtcagcagcattatagctctccgtggacgttcggtggaggcaccaagctggaaatcaaa

SEQ ID NO: 703 - DNA, 1332 bp, Artificial Sequence
  TB001 heavy chain DNA sequence
caggtgcagctggtgcagtccggctccgagctgaaaaaacccggcgcctccgtgaaagtgtcctgcaaagcctccggctacacattcacaaactacggcatgaactgggtgaggcaggcccccggccagggcctgaaatggatgggctggatcaacacaaacacaggcgagcccacatacgtggaggagttcacaggcaggttcgtgttctccctggagacatccgtgtccacagcctacctgcagatctcctccctgaaagccgaggacacagccgtgtacttctgcgccccctacgacaacttcttcgcctactggggccagggcacaacagtgacagtgtcctccgcttccaccaagggacccagcgtgttccctctggctccttgctccagatccacctccgagtctacagctgctctgggctgcctggtcaaggactactttcctgagcctgtgaccgtgtcctggaactctggcgctctgacatctggcgtgcacacctttccagctgtgctgcagtcctccggcctgtactctctgtcctctgtcgtgaccgtgccttcctctagcctgggcaccaagacctacacctgtaatgtggaccacaagccttccaacaccaaggtggacaagcgcgtggaatctaagtacggccctccttgtcctccatgtcctgctccagagtttctcggcggaccctccgtgttcctgtttcctccaaagcctaaggacaccctgatgatctctcggacccctgaagtgacctgcgtggtggtggatgtgtcccaagaggatcccgaggtgcagttcaattggtacgtggacggcgtggaagtgcacaacgccaagaccaagcctagagaggaacagttcaactccacctacagagtggtgtccgtgctgaccgtgctgcaccaggattggctgaacggcaaagagtacaagtgcaaggtgtccaacaagggcctgccttccagcatcgaaaagaccatctccaaggccaagggccagcctagggaaccccaggtttacaccctgcctccaagccaagaggaaatgaccaagaaccaggtgtccctgacctgcctcgtgaagggcttctacccttccgatatcgccgtggaatgggagagcaatggccagcctgagaacaactacaagacaacccctcctgtgctggactccgacggcagcttcttcctgtattcccgcctgaccgtggacaagtccagatggcaagagggcaacgtgttcagctgctccgtgatgcacgaggccctgcacaatcactacacccagaagtccctgtctctgtccctgggctgatga

SEQ ID NO: 704 - DNA, 1341 bp, Artificial Sequence
  TB006 heavy chain DNA sequence
cagattcaattggttcagagcggctcagaactgaaaaagcctggagccagcgttaaagtgagctgtaaagccagtggatacacattcaccacttacgtcatgtcctgggttagacaggcccctggacaggggctggaatggatgggctggataaacactcactctggagtgcccacatacgccgacgactttacaggcaggttcgtgttttccctagatactagtgtgaatactgcatacttgcaaatctcttctctgaaagcagaggataccgccgtgtacttttgcacccgcgatgggaatgatggggatgccatggacaactggggccaggggacgactgtgacagtgtcttcagctagcaccaagggccccagcgtgtttcctctcgctccctgcagccggagcacatccgagagcaccgctgctctgggctgtctcgtgaaggactacttccctgaacccgtcaccgtcagctggaatagcggcgccctgacatccggcgtccacacattccccgctgtcctgcagagcagcggcctgtacagcctgagctccgtggtcaccgtgcctagcagcagcctgggaacaaagacctacacctgcaacgtggaccataagccctccaacaccaaggtggacaagcgggtggaatccaagtatggacccccctgtcctccttgccctgctcctgaatttctcggaggcccctccgtcttcctgtttccccccaagcccaaggacaccctgatgatctcccggacacccgaagtcacctgcgtcgtggtggatgtcagccaggaagatcccgaggtgcagttcaactggtacgtggacggagtggaggtgcataacgccaaaaccaagcccagggaagagcagttcaacagcacctatcgggtcgtgtccgtgctcaccgtcctgcatcaggattggctcaacggcaaggagtacaagtgcaaggtgtccaacaagggcctgccctcctccatcgagaagaccatctccaaggctaagggccaacctcgggagccccaagtgtataccctccctcccagccaggaggagatgaccaagaatcaagtgagcctgacctgcctcgtgaagggattttacccctccgacatcgctgtggaatgggaaagcaatggccaacctgagaacaactacaagaccacaccccccgtgctggactccgatggctccttcttcctgtacagcaggctgaccgtggacaaatcccggtggcaagagggaaacgtgttcagctgctccgtgatgcacgaggctctccacaaccactacacccagaagagcctctccctgagcctcggctagtaa

SEQ ID NO: 705 - DNA, 1350 bp, Artificial Sequence
  12G5.D7 heavy chain DNA sequence
caggtgcagctgaagcagtctggggctgagctggtgaggcctggggcttcagtgaagctgtcctgcaaggcttctggctacactttcactgactactatataaactgggtgaagcagaggcctggacagggacttgagtggattgcaaggatttatcctggaactggtaatactgactacaatgagaagttcaagggcagggccacactgactgcagaaaactcctccagcactgcctacatgcagctcagcagtctgacatctgaggactctgctgtctatttctgtgcaagatttgcgtattactacggtagtggagggtactttgactactggggccacggcaccactctcacagtctcctcagctagcaccaagggccccagcgtgtttcctctcgctccctgcagccggagcacatccgagagcaccgctgctctgggctgtctcgtgaaggactacttccctgaacccgtcaccgtcagctggaatagcggcgccctgacatccggcgtccacacattccccgctgtcctgcagagcagcggcctgtacagcctgagctccgtggtcaccgtgcctagcagcagcctgggaacaaagacctacacctgcaacgtggaccataagccctccaacaccaaggtggacaagcgggtggaatccaagtatggacccccctgtcctccttgccctgctcctgaatttctcggaggcccctccgtcttcctgtttccccccaagcccaaggacaccctgatgatctcccggacacccgaagtcacctgcgtcgtggtggatgtcagccaggaagatcccgaggtgcagttcaactggtacgtggacggagtggaggtgcataacgccaaaaccaagcccagggaagagcagttcaacagcacctatcgggtcgtgtccgtgctcaccgtcctgcatcaggattggctcaacggcaaggagtacaagtgcaaggtgtccaacaagggcctgccctcctccatcgagaagaccatctccaaggctaagggccaacctcgggagccccaagtgtataccctccctcccagccaggaggagatgaccaagaatcaagtgagcctgacctgcctcgtgaagggattttacccctccgacatcgctgtggaatgggaaagcaatggccaacctgagaacaactacaagaccacaccccccgtgctggactccgatggctccttcttcctgtacagcaggctgaccgtggacaaatcccggtggcaagagggaaacgtgttcagctgctccgtgatgcacgaggctctccacaaccactacacccagaagagcctctccctgagcctcggctagtaa

SEQ ID NO: 706 - DNA, 1341 bp, Artificial Sequence
  13A12.2E5 heavy chain DNA sequence
cagatccagttggtacagtctggacctgagctgaagaagcctggagagacagtcaagatctcctgcaagacttctgggtataaattcaaaacctatgtgatgagctgggtgaaacaggctccaggaaaggctttaaagtggatgggctggataaacacctactctggagtgccaacatatgctgatgacttcaagggacgatttgccttctctttggaaacctctgccagcactgcctatttggagatcatcaacctcaaaaatgaggacacggctacatatttctgtgcaagagatggtaactacggggatcctatggactactggggtcaaggaacctcagtcaccgtctcctcagctagcaccaagggccccagcgtgtttcctctcgctccctgcagccggagcacatccgagagcaccgctgctctgggctgtctcgtgaaggactacttccctgaacccgtcaccgtcagctggaatagcggcgccctgacatccggcgtccacacattccccgctgtcctgcagagcagcggcctgtacagcctgagctccgtggtcaccgtgcctagcagcagcctgggaacaaagacctacacctgcaacgtggaccataagccctccaacaccaaggtggacaagcgggtggaatccaagtatggacccccctgtcctccttgccctgctcctgaatttctcggaggcccctccgtcttcctgtttccccccaagcccaaggacaccctgatgatctcccggacacccgaagtcacctgcgtcgtggtggatgtcagccaggaagatcccgaggtgcagttcaactggtacgtggacggagtggaggtgcataacgccaaaaccaagcccagggaagagcagttcaacagcacctatcgggtcgtgtccgtgctcaccgtcctgcatcaggattggctcaacggcaaggagtacaagtgcaaggtgtccaacaagggcctgccctcctccatcgagaagaccatctccaaggctaagggccaacctcgggagccccaagtgtataccctccctcccagccaggaggagatgaccaagaatcaagtgagcctgacctgcctcgtgaagggattttacccctccgacatcgctgtggaatgggaaagcaatggccaacctgagaacaactacaagaccacaccccccgtgctggactccgatggctccttcttcctgtacagcaggctgaccgtggacaaatcccggtggcaagagggaaacgtgttcagctgctccgtgatgcacgaggctctccacaaccactacacccagaagagcctctccctgagcctcggctagtaa

SEQ ID NO: 707 - DNA, 1335 bp, Artificial Sequence
  14H10.2C9 heavy chain DNA sequence
cagatccagttggtacagtctggacctgagctgaagaagcctggagagacagtcaagatctcctgcaaggcttctgggtataccttcacaacctatggaatgggctgggtgaaacaggctccaggaaaggatttaaagtggatgggctggataaacacctactctggagtgccaacatatgctgatgacttcaagggacggtttgccttctctttggaaacctctgccagcactgcctatttgcagatcagcaacctcaaaaatgaagacacggctacatatttctgttcaaccccttatgaatacgacggggcttactggggccaggggactctggtcactgtctctgcagctagcaccaagggccccagcgtgtttcctctcgctccctgcagccggagcacatccgagagcaccgctgctctgggctgtctcgtgaaggactacttccctgaacccgtcaccgtcagctggaatagcggcgccctgacatccggcgtccacacattccccgctgtcctgcagagcagcggcctgtacagcctgagctccgtggtcaccgtgcctagcagcagcctgggaacaaagacctacacctgcaacgtggaccataagccctccaacaccaaggtggacaagcgggtggaatccaagtatggacccccctgtcctccttgccctgctcctgaatttctcggaggcccctccgtcttcctgtttccccccaagcccaaggacaccctgatgatctcccggacacccgaagtcacctgcgtcgtggtggatgtcagccaggaagatcccgaggtgcagttcaactggtacgtggacggagtggaggtgcataacgccaaaaccaagcccagggaagagcagttcaacagcacctatcgggtcgtgtccgtgctcaccgtcctgcatcaggattggctcaacggcaaggagtacaagtgcaaggtgtccaacaagggcctgccctcctccatcgagaagaccatctccaaggctaagggccaacctcgggagccccaagtgtataccctccctcccagccaggaggagatgaccaagaatcaagtgagcctgacctgcctcgtgaagggattttacccctccgacatcgctgtggaatgggaaagcaatggccaacctgagaacaactacaagaccacaccccccgtgctggactccgatggctccttcttcctgtacagcaggctgaccgtggacaaatcccggtggcaagagggaaacgtgttcagctgctccgtgatgcacgaggctctccacaaccactacacccagaagagcctctccctgagcctcggctagtaa

SEQ ID NO: 708 - DNA, 1323 bp, Artificial Sequence
  15F10.2D6 heavy chain DNA sequence
gaagtacagctggtggagtctgggggaggcttagtgaagcctggagggtccctgaaactctcctgtgcagcctctggattcgctttcagttcctatgccatgtcttgggttcgccagactccggaaaagaggctggagtgggtcgcaaccattagtgatggtggtgtttacacctactatacagaccatgtaaagggccgattcaccatctccagagacaatgccgaggacaacctgtacctgcaaatgagccatctgaagtctgaggacacagccatgtattattgtgtgagagatgggggctactggggccaaggcaccactctcacagtctcctcagctagcaccaagggccccagcgtgtttcctctcgctccctgcagccggagcacatccgagagcaccgctgctctgggctgtctcgtgaaggactacttccctgaacccgtcaccgtcagctggaatagcggcgccctgacatccggcgtccacacattccccgctgtcctgcagagcagcggcctgtacagcctgagctccgtggtcaccgtgcctagcagcagcctgggaacaaagacctacacctgcaacgtggaccataagccctccaacaccaaggtggacaagcgggtggaatccaagtatggacccccctgtcctccttgccctgctcctgaatttctcggaggcccctccgtcttcctgtttccccccaagcccaaggacaccctgatgatctcccggacacccgaagtcacctgcgtcgtggtggatgtcagccaggaagatcccgaggtgcagttcaactggtacgtggacggagtggaggtgcataacgccaaaaccaagcccagggaagagcagttcaacagcacctatcgggtcgtgtccgtgctcaccgtcctgcatcaggattggctcaacggcaaggagtacaagtgcaaggtgtccaacaagggcctgccctcctccatcgagaagaccatctccaaggctaagggccaacctcgggagccccaagtgtataccctccctcccagccaggaggagatgaccaagaatcaagtgagcctgacctgcctcgtgaagggattttacccctccgacatcgctgtggaatgggaaagcaatggccaacctgagaacaactacaagaccacaccccccgtgctggactccgatggctccttcttcctgtacagcaggctgaccgtggacaaatcccggtggcaagagggaaacgtgttcagctgctccgtgatgcacgaggctctccacaaccactacacccagaagagcctctccctgagcctcggctagtaa

SEQ ID NO: 709 - DNA, 1332 bp, Artificial Sequence
  19B5.2E6 heavy chain DNA sequence
cagatccaacttgttcagagcgggcctgaattgaagaaaccaggcgagactgtaaagatctcctgtaaggccagtggctatacattcaccacctacgcaatgagctgggtcaagcaggcacccggaaagggtctgaagtggatgggttggataaatacatactcaggcgtcccaacctacgctgatgatttgaaggggcgctttgccttttctcttgaaacctcagcatcaaccgcctacttgcagataaataacctcaaaaatgaagacaccgctacctatttctgcgcaagggggccttatgctatggactactggggccagggcacctctgtgactgtaagttctgctagcaccaagggccccagcgtgtttcctctcgctccctgcagccggagcacatccgagagcaccgctgctctgggctgtctcgtgaaggactacttccctgaacccgtcaccgtcagctggaatagcggcgccctgacatccggcgtccacacattccccgctgtcctgcagagcagcggcctgtacagcctgagctccgtggtcaccgtgcctagcagcagcctgggaacaaagacctacacctgcaacgtggaccataagccctccaacaccaaggtggacaagcgggtggaatccaagtatggacccccctgtcctccttgccctgctcctgaatttctcggaggcccctccgtcttcctgtttccccccaagcccaaggacaccctgatgatctcccggacacccgaagtcacctgcgtcgtggtggatgtcagccaggaagatcccgaggtgcagttcaactggtacgtggacggagtggaggtgcataacgccaaaaccaagcccagggaagagcagttcaacagcacctatcgggtcgtgtccgtgctcaccgtcctgcatcaggattggctcaacggcaaggagtacaagtgcaaggtgtccaacaagggcctgccctcctccatcgagaagaccatctccaaggctaagggccaacctcgggagccccaagtgtataccctccctcccagccaggaggagatgaccaagaatcaagtgagcctgacctgcctcgtgaagggattttacccctccgacatcgctgtggaatgggaaagcaatggccaacctgagaacaactacaagaccacaccccccgtgctggactccgatggctccttcttcctgtacagcaggctgaccgtggacaaatcccggtggcaagagggaaacgtgttcagctgctccgtgatgcacgaggctctccacaaccactacacccagaagagcctctccctgagcctcggctagtaa

SEQ ID NO: 710 - DNA, 1329 bp, Artificial Sequence
  20D11.2C6 heavy chain DNA sequence
gaggtccagctgcaacaatctggacctgaactggtgaagcctggggcttcagtgaagatatcctgtaaggcttctggatacacgttcactgacttctacataaactgggtgaagcagagccatggaaagagccttgagtggattggagatattaatcctaagaatggtggtattaactacaacccgaagttcaagatcaaggccacattgactgtagacaagtcctccagcacatcctacatggacctccgcggcctgacatctgaggactctgcagtctattactgcacctcaggctacggatttccttactggggccaagggactctggtcactgtctctgcagctagcaccaagggccccagcgtgtttcctctcgctccctgcagccggagcacatccgagagcaccgctgctctgggctgtctcgtgaaggactacttccctgaacccgtcaccgtcagctggaatagcggcgccctgacatccggcgtccacacattccccgctgtcctgcagagcagcggcctgtacagcctgagctccgtggtcaccgtgcctagcagcagcctgggaacaaagacctacacctgcaacgtggaccataagccctccaacaccaaggtggacaagcgggtggaatccaagtatggacccccctgtcctccttgccctgctcctgaatttctcggaggcccctccgtcttcctgtttccccccaagcccaaggacaccctgatgatctcccggacacccgaagtcacctgcgtcgtggtggatgtcagccaggaagatcccgaggtgcagttcaactggtacgtggacggagtggaggtgcataacgccaaaaccaagcccagggaagagcagttcaacagcacctatcgggtcgtgtccgtgctcaccgtcctgcatcaggattggctcaacggcaaggagtacaagtgcaaggtgtccaacaagggcctgccctcctccatcgagaagaccatctccaaggctaagggccaacctcgggagccccaagtgtataccctccctcccagccaggaggagatgaccaagaatcaagtgagcctgacctgcctcgtgaagggattttacccctccgacatcgctgtggaatgggaaagcaatggccaacctgagaacaactacaagaccacaccccccgtgctggactccgatggctccttcttcctgtacagcaggctgaccgtggacaaatcccggtggcaagagggaaacgtgttcagctgctccgtgatgcacgaggctctccacaaccactacacccagaagagcctctccctgagcctcggctagtaa

SEQ ID NO: 711 - DNA, 1332 bp, Artificial Sequence
  20H5.A3 heavy chain DNA sequence
cagatccagttggtacagtctggacctgagctgaagaagcctggagagtcagtcaagatctcctgcaaggcttctggttatgccttcacaacctatggaatgagctgggtgcaacaggctccaggaaagggtttaaagtggatgggctgggtaaacacctactctggagtgccaacatgtgctgatgacttcaagggacggtttgccttctctttggaaacctctgccagcactgcctatttgcagatcaacaacctcagaaatgaggacacggctacatatttctgtgcaagagggccctatgctatggactactggggtcaaggaacctcagtcaccgtctcctcagctagcaccaagggccccagcgtgtttcctctcgctccctgcagccggagcacatccgagagcaccgctgctctgggctgtctcgtgaaggactacttccctgaacccgtcaccgtcagctggaatagcggcgccctgacatccggcgtccacacattccccgctgtcctgcagagcagcggcctgtacagcctgagctccgtggtcaccgtgcctagcagcagcctgggaacaaagacctacacctgcaacgtggaccataagccctccaacaccaaggtggacaagcgggtggaatccaagtatggacccccctgtcctccttgccctgctcctgaatttctcggaggcccctccgtcttcctgtttccccccaagcccaaggacaccctgatgatctcccggacacccgaagtcacctgcgtcgtggtggatgtcagccaggaagatcccgaggtgcagttcaactggtacgtggacggagtggaggtgcataacgccaaaaccaagcccagggaagagcagttcaacagcacctatcgggtcgtgtccgtgctcaccgtcctgcatcaggattggctcaacggcaaggagtacaagtgcaaggtgtccaacaagggcctgccctcctccatcgagaagaccatctccaaggctaagggccaacctcgggagccccaagtgtataccctccctcccagccaggaggagatgaccaagaatcaagtgagcctgacctgcctcgtgaagggattttacccctccgacatcgctgtggaatgggaaagcaatggccaacctgagaacaactacaagaccacaccccccgtgctggactccgatggctccttcttcctgtacagcaggctgaccgtggacaaatcccggtggcaagagggaaacgtgttcagctgctccgtgatgcacgaggctctccacaaccactacacccagaagagcctctccctgagcctcggctagtaa

SEQ ID NO: 712 - DNA, 1332 bp, Artificial Sequence
  23H9.2E4 heavy chain DNA sequence
cagatccagttggtacagtctggacctgagctgaagaagcctggagagacagtcaagatctcctgcaaggcttctgggtataccttcacaacctatgcaatgagctgggtgaaacaggctccaggaaagggtttaaagtggatgggctggataaacacctactctggagtgccaacatatgctgatgacctcaagggacggtttgccttctctttggaaacctctgccagcactgcctatttgcagatcaacaacctcaaaaatgaggacacggctacatatttctgtgcaagagggccctatgctatggactactggggtcaaggaacctcagtcaccgtctcctcagctagcaccaagggccccagcgtgtttcctctcgctccctgcagccggagcacatccgagagcaccgctgctctgggctgtctcgtgaaggactacttccctgaacccgtcaccgtcagctggaatagcggcgccctgacatccggcgtccacacattccccgctgtcctgcagagcagcggcctgtacagcctgagctccgtggtcaccgtgcctagcagcagcctgggaacaaagacctacacctgcaacgtggaccataagccctccaacaccaaggtggacaagcgggtggaatccaagtatggacccccctgtcctccttgccctgctcctgaatttctcggaggcccctccgtcttcctgtttccccccaagcccaaggacaccctgatgatctcccggacacccgaagtcacctgcgtcgtggtggatgtcagccaggaagatcccgaggtgcagttcaactggtacgtggacggagtggaggtgcataacgccaaaaccaagcccagggaagagcagttcaacagcacctatcgggtcgtgtccgtgctcaccgtcctgcatcaggattggctcaacggcaaggagtacaagtgcaaggtgtccaacaagggcctgccctcctccatcgagaagaccatctccaaggctaagggccaacctcgggagccccaagtgtataccctccctcccagccaggaggagatgaccaagaatcaagtgagcctgacctgcctcgtgaagggattttacccctccgacatcgctgtggaatgggaaagcaatggccaacctgagaacaactacaagaccacaccccccgtgctggactccgatggctccttcttcctgtacagcaggctgaccgtggacaaatcccggtggcaagagggaaacgtgttcagctgctccgtgatgcacgaggctctccacaaccactacacccagaagagcctctccctgagcctcggctagtaa

SEQ ID NO: 713 - DNA, 1344 bp, Artificial Sequence
  2D10-VH0-VL0 heavy chain DNA sequence
caagtacagctccagcaatcaggacctgaacttgttaagccaggtgcaagcgtcaaaataagttgtaaagcatcaggttacacctttacagactactatatcaactgggtcaagcaacggcctggtcagggacttgaatggataggttggatctaccctgggtcacaagacaccaagtacaatgaaaaatttaaggggaaagccactctgacagtagatactagctcaagtaccgcctacatgcagctcggcagcctcacttccgaggactctgccgtatatttctgtgccaactacttcgggtcttctgggtggttctttgatgtgtggggaaccggcaccaccgtaaccgtttcctcagctagcaccaagggccccagcgtgtttcctctcgctccctgcagccggagcacatccgagagcaccgctgctctgggctgtctcgtgaaggactacttccctgaacccgtcaccgtcagctggaatagcggcgccctgacatccggcgtccacacattccccgctgtcctgcagagcagcggcctgtacagcctgagctccgtggtcaccgtgcctagcagcagcctgggaacaaagacctacacctgcaacgtggaccataagccctccaacaccaaggtggacaagcgggtggaatccaagtatggacccccctgtcctccttgccctgctcctgaatttctcggaggcccctccgtcttcctgtttccccccaagcccaaggacaccctgatgatctcccggacacccgaagtcacctgcgtcgtggtggatgtcagccaggaagatcccgaggtgcagttcaactggtacgtggacggagtggaggtgcataacgccaaaaccaagcccagggaagagcagttcaacagcacctatcgggtcgtgtccgtgctcaccgtcctgcatcaggattggctcaacggcaaggagtacaagtgcaaggtgtccaacaagggcctgccctcctccatcgagaagaccatctccaaggctaagggccaacctcgggagccccaagtgtataccctccctcccagccaggaggagatgaccaagaatcaagtgagcctgacctgcctcgtgaagggattttacccctccgacatcgctgtggaatgggaaagcaatggccaacctgagaacaactacaagaccacaccccccgtgctggactccgatggctccttcttcctgtacagcaggctgaccgtggacaaatcccggtggcaagagggaaacgtgttcagctgctccgtgatgcacgaggctctccacaaccactacacccagaagagcctctccctgagcctcggctagtaa

SEQ ID NO: 714 - DNA, 1341 bp, Artificial Sequence
  3B11.2G2 heavy chain DNA sequence
cagatccagttggtacagtctggacctgagctgaagaagcctggagagacagtcaagatctcctgcaagacttctgggtataaattcaaaacctatgtaatgagctgggtgaaacaggctccaggaaaggctttaaagtggatgggctggataaacacctactctggagtgccaacatatgctgatgacttcaagggacggtttgccttctctttggaaacctctgccagcactgcctatttggagatcatcaacctcaaaaatgaggacacggctacatatttctgtgcaagagatggtaattacggggatcctatggactactggggtcaaggaacctcagtcaccgtctcctcagctagcaccaagggccccagcgtgtttcctctcgctccctgcagccggagcacatccgagagcaccgctgctctgggctgtctcgtgaaggactacttccctgaacccgtcaccgtcagctggaatagcggcgccctgacatccggcgtccacacattccccgctgtcctgcagagcagcggcctgtacagcctgagctccgtggtcaccgtgcctagcagcagcctgggaacaaagacctacacctgcaacgtggaccataagccctccaacaccaaggtggacaagcgggtggaatccaagtatggacccccctgtcctccttgccctgctcctgaatttctcggaggcccctccgtcttcctgtttccccccaagcccaaggacaccctgatgatctcccggacacccgaagtcacctgcgtcgtggtggatgtcagccaggaagatcccgaggtgcagttcaactggtacgtggacggagtggaggtgcataacgccaaaaccaagcccagggaagagcagttcaacagcacctatcgggtcgtgtccgtgctcaccgtcctgcatcaggattggctcaacggcaaggagtacaagtgcaaggtgtccaacaagggcctgccctcctccatcgagaagaccatctccaaggctaagggccaacctcgggagccccaagtgtataccctccctcccagccaggaggagatgaccaagaatcaagtgagcctgacctgcctcgtgaagggattttacccctccgacatcgctgtggaatgggaaagcaatggccaacctgagaacaactacaagaccacaccccccgtgctggactccgatggctccttcttcctgtacagcaggctgaccgtggacaaatcccggtggcaagagggaaacgtgttcagctgctccgtgatgcacgaggctctccacaaccactacacccagaagagcctctccctgagcctcggctagtaa

SEQ ID NO: 715 - DNA, 1323 bp, Artificial Sequence
  7D8.2D8 heavy chain DNA sequence
gaagtgcagctggtggagtctgggggaggcttagtgaagcctggagggtccctgaaactctcctgtgcagcctctggattcactttcagtagctatgccatgtcttgggttcgccagactccggaaaagaggctggagtgggtcgcaaccatcagtgatggtggtatttacacctactatccagacaatgtaaagggccgattcaccatttccagagacaatgccaagaacaacctgttcctgcaaatgagccatctgaagtctgaggatacagccatgtattactgtgtaagagatgggggctactggggccaaggcaccactctcacagtctcctcagctagcaccaagggccccagcgtgtttcctctcgctccctgcagccggagcacatccgagagcaccgctgctctgggctgtctcgtgaaggactacttccctgaacccgtcaccgtcagctggaatagcggcgccctgacatccggcgtccacacattccccgctgtcctgcagagcagcggcctgtacagcctgagctccgtggtcaccgtgcctagcagcagcctgggaacaaagacctacacctgcaacgtggaccataagccctccaacaccaaggtggacaagcgggtggaatccaagtatggacccccctgtcctccttgccctgctcctgaatttctcggaggcccctccgtcttcctgtttccccccaagcccaaggacaccctgatgatctcccggacacccgaagtcacctgcgtcgtggtggatgtcagccaggaagatcccgaggtgcagttcaactggtacgtggacggagtggaggtgcataacgccaaaaccaagcccagggaagagcagttcaacagcacctatcgggtcgtgtccgtgctcaccgtcctgcatcaggattggctcaacggcaaggagtacaagtgcaaggtgtccaacaagggcctgccctcctccatcgagaagaccatctccaaggctaagggccaacctcgggagccccaagtgtataccctccctcccagccaggaggagatgaccaagaatcaagtgagcctgacctgcctcgtgaagggattttacccctccgacatcgctgtggaatgggaaagcaatggccaacctgagaacaactacaagaccacaccccccgtgctggactccgatggctccttcttcctgtacagcaggctgaccgtggacaaatcccggtggcaagagggaaacgtgttcagctgctccgtgatgcacgaggctctccacaaccactacacccagaagagcctctccctgagcctcggctagtaa

SEQ ID NO: 716 - DNA, 1344 bp, Artificial Sequence
  mIMT001 heavy chain DNA sequence
cagatccaacttgtgcagtcaggtccagaattgaagaagcctggtgagaccgtcaagatttcctgtaaggcctctggttatacttttaccaactatggcatgaattgggtcaagcaggcacctgggaagggtttgaaatggatggggtggataaataccaacacaggggaaccaacttacgttgaagagtttaagggtcgttttgcattcagtcttgagacttctgcaagcacagcttacctccaaattaacaatctcaaaaatgaagatactgctacatatttctgtgctccttatgataattttttcgcctactggggacagggaactctggtcaccgtctcagcagctaagactactcctcccagtgtctaccccctggcccccgtgtgcggcgacacaacaggctcctccgtgacactgggctgcctggtgaaaggctacttccccgagcccgtgacactgacatggaactccggctccctgtcctccggcgtgcacacattccccgccgtgctgcagtccgacctgtacacactgtcctcctccgtgacagtgacatcctccacatggccctcccagtccatcacatgcaacgtggcccaccccgcctcctccacaaaagtggacaaaaaaatcgagcccaggggccccacaatcaaaccctgccccccctgcaaatgccccgcccccaacgccgccggcggcccctccgtgttcatcttcccccccaaaatcaaagacgtgctgatgatctccctgtcccccatcgtgacatgcgtggtggtggacgtgtccgaggacgaccccgacgtgcagatctcctggttcgtgaacaacgtggaggtgcacacagcccagacacagacacacagggaggactacaactccacactgagggtggtgtccgccctgcccatccagcaccaggactggatgtccggcaaagagttcaaatgcaaagtgaacaacaaagacctgggcgcccccatcgagaggacaatctccaaacccaaaggctccgtgagggccccccaggtgtacgtgctgcccccccccgaggaggagatgacaaaaaaacaggtgacactgacatgcatggtgacagacttcatgcccgaggacatctacgtggagtggacaaacaacggcaaaacagagctgaactacaaaaacacagagcccgtgctggactccgacggctcctacttcatgtactccaaactgagggtggagaaaaaaaactgggtggagaggaactcctactcctgctccgtggtgcacgagggcctgcacaaccaccacacaacaaaatccttctccaggacacccggcaaatagtaa

SEQ ID NO: 717 - DNA, 1332 bp, Artificial Sequence
  4A11.2B5 heavy chain DNA sequence
caggtacaacttcagcagagcggtccagaacttgtgaagcccggtgctagtgtcaaaatatcttgcaaagcaagtggttattccttcaccaactattacatacactgggtaaaacaacgtccagggcaaggactcgaatggattggttggatctaccccggcagcggcaacactaactacaacgagaagtttaaaggcaaagctactctcacagcagacacttctagcagtacaacaaatatgcagttgtcctctctgacttccgaagacagcgccgtctattactgttctactgcacccggaggttttgacgtctggggttccggcaccacagttaccgttagttccgctagcaccaagggccccagcgtgtttcctctcgctccctgcagccggagcacatccgagagcaccgctgctctgggctgtctcgtgaaggactacttccctgaacccgtcaccgtcagctggaatagcggcgccctgacatccggcgtccacacattccccgctgtcctgcagagcagcggcctgtacagcctgagctccgtggtcaccgtgcctagcagcagcctgggaacaaagacctacacctgcaacgtggaccataagccctccaacaccaaggtggacaagcgggtggaatccaagtatggacccccctgtcctccttgccctgctcctgaatttctcggaggcccctccgtcttcctgtttccccccaagcccaaggacaccctgatgatctcccggacacccgaagtcacctgcgtcgtggtggatgtcagccaggaagatcccgaggtgcagttcaactggtacgtggacggagtggaggtgcataacgccaaaaccaagcccagggaagagcagttcaacagcacctatcgggtcgtgtccgtgctcaccgtcctgcatcaggattggctcaacggcaaggagtacaagtgcaaggtgtccaacaagggcctgccctcctccatcgagaagaccatctccaaggctaagggccaacctcgggagccccaagtgtataccctccctcccagccaggaggagatgaccaagaatcaagtgagcctgacctgcctcgtgaagggattttacccctccgacatcgctgtggaatgggaaagcaatggccaacctgagaacaactacaagaccacaccccccgtgctggactccgatggctccttcttcctgtacagcaggctgaccgtggacaaatcccggtggcaagagggaaacgtgttcagctgctccgtgatgcacgaggctctccacaaccactacacccagaagagcctctccctgagcctcggctagtaa

SEQ ID NO: 718 - DNA, 1332 bp, Artificial Sequence
  4A11.H1L1 heavy chain DNA sequence
caggtgcagctggtgcaatcaggagccgaagttaagaagcctggcgccagcgtcaaggtctcatgtaaagcctccggttacagtttcaccaactactatatgcactgggttaggcaagcaccaggccaggggcttgagtggatgggatggatctatccagggagcggtaacaccaattacaatgagaagtttcaagggcgcgtaaccatgacagcagataccagtataagcaccgcctatatggaactctctcggttgagatccgatgataccgctgtttattactgctctaccgcacctggtggtttcgacgtttggggccaaggtactacagtgaccgtatcatcagctagcaccaagggccccagcgtgtttcctctcgctccctgcagccggagcacatccgagagcaccgctgctctgggctgtctcgtgaaggactacttccctgaacccgtcaccgtcagctggaatagcggcgccctgacatccggcgtccacacattccccgctgtcctgcagagcagcggcctgtacagcctgagctccgtggtcaccgtgcctagcagcagcctgggaacaaagacctacacctgcaacgtggaccataagccctccaacaccaaggtggacaagcgggtggaatccaagtatggacccccctgtcctccttgccctgctcctgaatttctcggaggcccctccgtcttcctgtttccccccaagcccaaggacaccctgatgatctcccggacacccgaagtcacctgcgtcgtggtggatgtcagccaggaagatcccgaggtgcagttcaactggtacgtggacggagtggaggtgcataacgccaaaaccaagcccagggaagagcagttcaacagcacctatcgggtcgtgtccgtgctcaccgtcctgcatcaggattggctcaacggcaaggagtacaagtgcaaggtgtccaacaagggcctgccctcctccatcgagaagaccatctccaaggctaagggccaacctcgggagccccaagtgtataccctccctcccagccaggaggagatgaccaagaatcaagtgagcctgacctgcctcgtgaagggattttacccctccgacatcgctgtggaatgggaaagcaatggccaacctgagaacaactacaagaccacaccccccgtgctggactccgatggctccttcttcctgtacagcaggctgaccgtggacaaatcccggtggcaagagggaaacgtgttcagctgctccgtgatgcacgaggctctccacaaccactacacccagaagagcctctccctgagcctcggctagtaa

SEQ ID NO: 719 - DNA, 1332 bp, Artificial Sequence
  4A11.H4L2 heavy chain DNA sequence
caggtgcaactggtccagtctggggccgaggtcaaaaagcctggagcctccgtcaaagtgtcatgtaaagcctcagggtatagtttcaccaactactatatacattgggtcagacaagccccaggccagcgtcttgagtggatgggatggatttatcccggatcagggaatacaaactataacgagaaatttcaaggcagagttactctcactgccgatacctctgcaagtactacctatatggagctctccagtctcagaagcgaagacacagcagtatattactgtagcaccgccccaggcgggtttgacgtgtggggccaaggcactactgtaaccgttagctcagctagcaccaagggccccagcgtgtttcctctcgctccctgcagccggagcacatccgagagcaccgctgctctgggctgtctcgtgaaggactacttccctgaacccgtcaccgtcagctggaatagcggcgccctgacatccggcgtccacacattccccgctgtcctgcagagcagcggcctgtacagcctgagctccgtggtcaccgtgcctagcagcagcctgggaacaaagacctacacctgcaacgtggaccataagccctccaacaccaaggtggacaagcgggtggaatccaagtatggacccccctgtcctccttgccctgctcctgaatttctcggaggcccctccgtcttcctgtttccccccaagcccaaggacaccctgatgatctcccggacacccgaagtcacctgcgtcgtggtggatgtcagccaggaagatcccgaggtgcagttcaactggtacgtggacggagtggaggtgcataacgccaaaaccaagcccagggaagagcagttcaacagcacctatcgggtcgtgtccgtgctcaccgtcctgcatcaggattggctcaacggcaaggagtacaagtgcaaggtgtccaacaagggcctgccctcctccatcgagaagaccatctccaaggctaagggccaacctcgggagccccaagtgtataccctccctcccagccaggaggagatgaccaagaatcaagtgagcctgacctgcctcgtgaagggattttacccctccgacatcgctgtggaatgggaaagcaatggccaacctgagaacaactacaagaccacaccccccgtgctggactccgatggctccttcttcctgtacagcaggctgaccgtggacaaatcccggtggcaagagggaaacgtgttcagctgctccgtgatgcacgaggctctccacaaccactacacccagaagagcctctccctgagcctcggctagtaa

SEQ ID NO: 720 - DNA, 1341 bp, Artificial Sequence
  4G2.2G6 heavy chain DNA sequence
caaatacagctcgtgcagtctggtcccgatttgaagaagcctggagaaaccgtaaagataagctgtaaggctagtggttacactttcacaacatacgttatgtcatgggttaaacaggctcctggaaaagaccttaaatggatgggatggattaacacccatagcggtgtcccaacttacgctgacgattttaagggacgatttgacttttctctcgaaacttctgccaacacagcttttttgcagatcaacaatctcaagaatgaagacaccgcaacctatttctgcactcgagatgggaacgacggggatgcaatggataactggggacaaggcacatcagttaccgtgagctctgctagcaccaagggccccagcgtgtttcctctcgctccctgcagccggagcacatccgagagcaccgctgctctgggctgtctcgtgaaggactacttccctgaacccgtcaccgtcagctggaatagcggcgccctgacatccggcgtccacacattccccgctgtcctgcagagcagcggcctgtacagcctgagctccgtggtcaccgtgcctagcagcagcctgggaacaaagacctacacctgcaacgtggaccataagccctccaacaccaaggtggacaagcgggtggaatccaagtatggacccccctgtcctccttgccctgctcctgaatttctcggaggcccctccgtcttcctgtttccccccaagcccaaggacaccctgatgatctcccggacacccgaagtcacctgcgtcgtggtggatgtcagccaggaagatcccgaggtgcagttcaactggtacgtggacggagtggaggtgcataacgccaaaaccaagcccagggaagagcagttcaacagcacctatcgggtcgtgtccgtgctcaccgtcctgcatcaggattggctcaacggcaaggagtacaagtgcaaggtgtccaacaagggcctgccctcctccatcgagaagaccatctccaaggctaagggccaacctcgggagccccaagtgtataccctccctcccagccaggaggagatgaccaagaatcaagtgagcctgacctgcctcgtgaagggattttacccctccgacatcgctgtggaatgggaaagcaatggccaacctgagaacaactacaagaccacaccccccgtgctggactccgatggctccttcttcctgtacagcaggctgaccgtggacaaatcccggtggcaagagggaaacgtgttcagctgctccgtgatgcacgaggctctccacaaccactacacccagaagagcctctccctgagcctcggctagtaa

SEQ ID NO: 721 - DNA, 1344 bp, Artificial Sequence
  6B3.2D3 heavy chain DNA sequence
caggtgcagctgaagcagtcaggacctggcctagtgcagccctcacagagcctgtccatcacctgcacagtctctggtttctcattaactagttatggtgtacactgggttcgccagcctccaggaaagggtctggagtggctgggagtgatatggagtggtggaagcacagactataatgctgctttcatatccagactgagcatcagtaaggacaactccaagagccaagttttctttaaaatgaacagtctgcaagctgatgacactgccatatactactgtgccaaagggccttatgattacgacttaggctggtttgcttactggggccaagggactctggtcactgtctctgcagctagcaccaagggccccagcgtgtttcctctcgctccctgcagccggagcacatccgagagcaccgctgctctgggctgtctcgtgaaggactacttccctgaacccgtcaccgtcagctggaatagcggcgccctgacatccggcgtccacacattccccgctgtcctgcagagcagcggcctgtacagcctgagctccgtggtcaccgtgcctagcagcagcctgggaacaaagacctacacctgcaacgtggaccataagccctccaacaccaaggtggacaagcgggtggaatccaagtatggacccccctgtcctccttgccctgctcctgaatttctcggaggcccctccgtcttcctgtttccccccaagcccaaggacaccctgatgatctcccggacacccgaagtcacctgcgtcgtggtggatgtcagccaggaagatcccgaggtgcagttcaactggtacgtggacggagtggaggtgcataacgccaaaaccaagcccagggaagagcagttcaacagcacctatcgggtcgtgtccgtgctcaccgtcctgcatcaggattggctcaacggcaaggagtacaagtgcaaggtgtccaacaagggcctgccctcctccatcgagaagaccatctccaaggctaagggccaacctcgggagccccaagtgtataccctccctcccagccaggaggagatgaccaagaatcaagtgagcctgacctgcctcgtgaagggattttacccctccgacatcgctgtggaatgggaaagcaatggccaacctgagaacaactacaagaccacaccccccgtgctggactccgatggctccttcttcctgtacagcaggctgaccgtggacaaatcccggtggcaagagggaaacgtgttcagctgctccgtgatgcacgaggctctccacaaccactacacccagaagagcctctccctgagcctcggctagtaa

SEQ ID NO: 722 - DNA, 1332 bp, Artificial Sequence
  6H6.2D6 heavy chain DNA sequence
cagatccagctggtgcagtccggccccgagctgaagaagcccggcgagactgtgaagatctcctgcaaggcctccggctacaccttcaccacctacggcatgtcctgggtgaagcaggcccccggcaagggcctgaagtggatggcctggatcaacacctactccggcgtgcccacctacgccgacgacttcaagggcaggttcgccttctccctggagacttccgcctccaccgcctacctgcagatcaacaacctgaccaacgaggacaccgccacctacttctgcgccaggggcccctacgccatggactactggggccagggcacctccgtgaccgtgtcctccgctagcaccaagggccccagcgtgtttcctctcgctccctgcagccggagcacatccgagagcaccgctgctctgggctgtctcgtgaaggactacttccctgaacccgtcaccgtcagctggaatagcggcgccctgacatccggcgtccacacattccccgctgtcctgcagagcagcggcctgtacagcctgagctccgtggtcaccgtgcctagcagcagcctgggaacaaagacctacacctgcaacgtggaccataagccctccaacaccaaggtggacaagcgggtggaatccaagtatggacccccctgtcctccttgccctgctcctgaatttctcggaggcccctccgtcttcctgtttccccccaagcccaaggacaccctgatgatctcccggacacccgaagtcacctgcgtcgtggtggatgtcagccaggaagatcccgaggtgcagttcaactggtacgtggacggagtggaggtgcataacgccaaaaccaagcccagggaagagcagttcaacagcacctatcgggtcgtgtccgtgctcaccgtcctgcatcaggattggctcaacggcaaggagtacaagtgcaaggtgtccaacaagggcctgccctcctccatcgagaagaccatctccaaggctaagggccaacctcgggagccccaagtgtataccctccctcccagccaggaggagatgaccaagaatcaagtgagcctgacctgcctcgtgaagggattttacccctccgacatcgctgtggaatgggaaagcaatggccaacctgagaacaactacaagaccacaccccccgtgctggactccgatggctccttcttcctgtacagcaggctgaccgtggacaaatcccggtggcaagagggaaacgtgttcagctgctccgtgatgcacgaggctctccacaaccactacacccagaagagcctctccctgagcctcggctagtaa

SEQ ID NO: 723 - DNA, 1329 bp, Artificial Sequence
  9H2.2H10 heavy chain DNA sequence
caggtccagctgcagcagcctggggctgaactggtggggcctgggtcttcagtgaagctgtcctgcaaggcttctggctacaccttcaccaactactggatacattgggtgaagcagaggcctctacaaggccttgaatggattggtaacattgacccttctgatagtgaaactcactacaatcaaaagttcaaggacaaggccacattgactgtagacaaatcctccagcacagcctacatgcaactcagcagcctgacatctgaggactctgcggtctattactgtgcaagacatggttactacgactactggggccaaggcaccactctcacagtctcctcagctagcaccaagggccccagcgtgtttcctctcgctccctgcagccggagcacatccgagagcaccgctgctctgggctgtctcgtgaaggactacttccctgaacccgtcaccgtcagctggaatagcggcgccctgacatccggcgtccacacattccccgctgtcctgcagagcagcggcctgtacagcctgagctccgtggtcaccgtgcctagcagcagcctgggaacaaagacctacacctgcaacgtggaccataagccctccaacaccaaggtggacaagcgggtggaatccaagtatggacccccctgtcctccttgccctgctcctgaatttctcggaggcccctccgtcttcctgtttccccccaagcccaaggacaccctgatgatctcccggacacccgaagtcacctgcgtcgtggtggatgtcagccaggaagatcccgaggtgcagttcaactggtacgtggacggagtggaggtgcataacgccaaaaccaagcccagggaagagcagttcaacagcacctatcgggtcgtgtccgtgctcaccgtcctgcatcaggattggctcaacggcaaggagtacaagtgcaaggtgtccaacaagggcctgccctcctccatcgagaagaccatctccaaggctaagggccaacctcgggagccccaagtgtataccctccctcccagccaggaggagatgaccaagaatcaagtgagcctgacctgcctcgtgaagggattttacccctccgacatcgctgtggaatgggaaagcaatggccaacctgagaacaactacaagaccacaccccccgtgctggactccgatggctccttcttcctgtacagcaggctgaccgtggacaaatcccggtggcaagagggaaacgtgttcagctgctccgtgatgcacgaggctctccacaaccactacacccagaagagcctctccctgagcctcggctagtaa

SEQ ID NO: 724 - DNA, 1341 bp, Artificial Sequence
  13G4.2F8 heavy chain DNA sequence
caggtccagctgcagcagcctggggctgagctggtaaagcctggggcttcagtgaagttgtcctgcaaggcttctggctacactttcaccagctactggatgcactgggtgaagcagaggcctggacaaggccttgagtggattggaatgattcatcctaacagtggtagtactgactacaatgagaagttcaagaacaaggccacactgaatgtagacaaatcctccagtacagcctacatacaactcagcagcctgacatctgaggactctgcggtctattactgtacaagatgggggatttattactacgcgagggactactggggccaaggcaccactctcacagtctcctcagctagcaccaagggccccagcgtgtttcctctcgctccctgcagccggagcacatccgagagcaccgctgctctgggctgtctcgtgaaggactacttccctgaacccgtcaccgtcagctggaatagcggcgccctgacatccggcgtccacacattccccgctgtcctgcagagcagcggcctgtacagcctgagctccgtggtcaccgtgcctagcagcagcctgggaacaaagacctacacctgcaacgtggaccataagccctccaacaccaaggtggacaagcgggtggaatccaagtatggacccccctgtcctccttgccctgctcctgaatttctcggaggcccctccgtcttcctgtttccccccaagcccaaggacaccctgatgatctcccggacacccgaagtcacctgcgtcgtggtggatgtcagccaggaagatcccgaggtgcagttcaactggtacgtggacggagtggaggtgcataacgccaaaaccaagcccagggaagagcagttcaacagcacctatcgggtcgtgtccgtgctcaccgtcctgcatcaggattggctcaacggcaaggagtacaagtgcaaggtgtccaacaagggcctgccctcctccatcgagaagaccatctccaaggctaagggccaacctcgggagccccaagtgtataccctccctcccagccaggaggagatgaccaagaatcaagtgagcctgacctgcctcgtgaagggattttacccctccgacatcgctgtggaatgggaaagcaatggccaacctgagaacaactacaagaccacaccccccgtgctggactccgatggctccttcttcctgtacagcaggctgaccgtggacaaatcccggtggcaagagggaaacgtgttcagctgctccgtgatgcacgaggctctccacaaccactacacccagaagagcctctccctgagcctcggctagtaa

SEQ ID NO: 725 - DNA, 1335 bp, Artificial Sequence
  13H12.2F8 heavy chain DNA sequence
cagatccagctggtccaatcaggacccgaactgaaaaaaccaggcgagacagtcaaaatcagctgtaaggcctcaggctacactttcacaacctacgggatgtcatgggtaaagcaagctcctggcaaggggctgaaatggatgggttggatcaacacatactctggagtgcccacctacgctgacgactttaagggtagattcgcatttagcctggaaacaagtgccagtacagcctacctccagataaacaacttgaaaaacgaggataccgcaacctatttttgcgccgtcccctacgagtacgacggtgcctattggggtcagggtacactcgtaacagtttccgccgctagcaccaagggccccagcgtgtttcctctcgctccctgcagccggagcacatccgagagcaccgctgctctgggctgtctcgtgaaggactacttccctgaacccgtcaccgtcagctggaatagcggcgccctgacatccggcgtccacacattccccgctgtcctgcagagcagcggcctgtacagcctgagctccgtggtcaccgtgcctagcagcagcctgggaacaaagacctacacctgcaacgtggaccataagccctccaacaccaaggtggacaagcgggtggaatccaagtatggacccccctgtcctccttgccctgctcctgaatttctcggaggcccctccgtcttcctgtttccccccaagcccaaggacaccctgatgatctcccggacacccgaagtcacctgcgtcgtggtggatgtcagccaggaagatcccgaggtgcagttcaactggtacgtggacggagtggaggtgcataacgccaaaaccaagcccagggaagagcagttcaacagcacctatcgggtcgtgtccgtgctcaccgtcctgcatcaggattggctcaacggcaaggagtacaagtgcaaggtgtccaacaagggcctgccctcctccatcgagaagaccatctccaaggctaagggccaacctcgggagccccaagtgtataccctccctcccagccaggaggagatgaccaagaatcaagtgagcctgacctgcctcgtgaagggattttacccctccgacatcgctgtggaatgggaaagcaatggccaacctgagaacaactacaagaccacaccccccgtgctggactccgatggctccttcttcctgtacagcaggctgaccgtggacaaatcccggtggcaagagggaaacgtgttcagctgctccgtgatgcacgaggctctccacaaccactacacccagaagagcctctccctgagcctcggctagtaa

SEQ ID NO: 726 - DNA, 1329 bp, Artificial Sequence
  15G7.2A7 heavy chain DNA sequence
gaggtccagctgcaacaatctggacctgagctggtgaagcctggggcttcagtgaagatatcctgtaaggcttctggatacacgttcactgactactacatgaactgggtgaagcagagccatggaaagagccttgagtggattggagatattaatcctaacaatggtggtactaactacaaccagaagttcaagggcaaggccacattgactgtagacaagtcctccagcacagcctacatggagctccgcagcctgacatctgaggactctgcagtctattactgcacctcaggctacgggtttccttactggggccaggggactctggtcactgtctctgcagctagcaccaagggccccagcgtgtttcctctcgctccctgcagccggagcacatccgagagcaccgctgctctgggctgtctcgtgaaggactacttccctgaacccgtcaccgtcagctggaatagcggcgccctgacatccggcgtccacacattccccgctgtcctgcagagcagcggcctgtacagcctgagctccgtggtcaccgtgcctagcagcagcctgggaacaaagacctacacctgcaacgtggaccataagccctccaacaccaaggtggacaagcgggtggaatccaagtatggacccccctgtcctccttgccctgctcctgaatttctcggaggcccctccgtcttcctgtttccccccaagcccaaggacaccctgatgatctcccggacacccgaagtcacctgcgtcgtggtggatgtcagccaggaagatcccgaggtgcagttcaactggtacgtggacggagtggaggtgcataacgccaaaaccaagcccagggaagagcagttcaacagcacctatcgggtcgtgtccgtgctcaccgtcctgcatcaggattggctcaacggcaaggagtacaagtgcaaggtgtccaacaagggcctgccctcctccatcgagaagaccatctccaaggctaagggccaacctcgggagccccaagtgtataccctccctcccagccaggaggagatgaccaagaatcaagtgagcctgacctgcctcgtgaagggattttacccctccgacatcgctgtggaatgggaaagcaatggccaacctgagaacaactacaagaccacaccccccgtgctggactccgatggctccttcttcctgtacagcaggctgaccgtggacaaatcccggtggcaagagggaaacgtgttcagctgctccgtgatgcacgaggctctccacaaccactacacccagaagagcctctccctgagcctcggctagtaa

SEQ ID NO: 727 - DNA, 1335 bp, Artificial Sequence
  19D9.2E5 heavy chain DNA sequence
cagatccagttggtacagtctggacctgagctgaagaagcctggagagacagtcaagatctcctgcaaggcttctggatataccttcacaacctatggaatgggctgggtgaaacaggctccaggaaagggtttgaagtggatgggctggataaacacctactctggcgtgccaacatatgctgatgacttcaagggacggtttgccttctctttggaaacctctaccagcactgcctatttgcagatcaacaacctcaaaaatgaggacatggctacatatttctgtgcaaccccttatgaatacgacggggcttactggggccaagggactctggtcactgtctctgcagctagcaccaagggccccagcgtgtttcctctcgctccctgcagccggagcacatccgagagcaccgctgctctgggctgtctcgtgaaggactacttccctgaacccgtcaccgtcagctggaatagcggcgccctgacatccggcgtccacacattccccgctgtcctgcagagcagcggcctgtacagcctgagctccgtggtcaccgtgcctagcagcagcctgggaacaaagacctacacctgcaacgtggaccataagccctccaacaccaaggtggacaagcgggtggaatccaagtatggacccccctgtcctccttgccctgctcctgaatttctcggaggcccctccgtcttcctgtttccccccaagcccaaggacaccctgatgatctcccggacacccgaagtcacctgcgtcgtggtggatgtcagccaggaagatcccgaggtgcagttcaactggtacgtggacggagtggaggtgcataacgccaaaaccaagcccagggaagagcagttcaacagcacctatcgggtcgtgtccgtgctcaccgtcctgcatcaggattggctcaacggcaaggagtacaagtgcaaggtgtccaacaagggcctgccctcctccatcgagaagaccatctccaaggctaagggccaacctcgggagccccaagtgtataccctccctcccagccaggaggagatgaccaagaatcaagtgagcctgacctgcctcgtgaagggattttacccctccgacatcgctgtggaatgggaaagcaatggccaacctgagaacaactacaagaccacaccccccgtgctggactccgatggctccttcttcctgtacagcaggctgaccgtggacaaatcccggtggcaagagggaaacgtgttcagctgctccgtgatgcacgaggctctccacaaccactacacccagaagagcctctccctgagcctcggctagtaa

SEQ ID NO: 728 - DNA, 1320 bp, Artificial Sequence
  23B10.2B12 heavy chain DNA sequence
caggtccagctgcagcagtctggacctgaactggtgaagcctggggattctgtgaagatatcctgcaaggctgctggctacaccttcagtgactattatataaactgggtgaagcagaggcctggacagggacttgagtggattggatggatttatcctgtaagcgttaatactaagtacaatgagaagttcaagggcaaggccacattgactgtagacacatcctccagcacagcctacatgcagctcagcagcctgacctctgaggactctggggtctatttctgtgcctaccttgattattggggccaagggactctggtcactgtctctgcagctagcaccaagggccccagcgtgtttcctctcgctccctgcagccggagcacatccgagagcaccgctgctctgggctgtctcgtgaaggactacttccctgaacccgtcaccgtcagctggaatagcggcgccctgacatccggcgtccacacattccccgctgtcctgcagagcagcggcctgtacagcctgagctccgtggtcaccgtgcctagcagcagcctgggaacaaagacctacacctgcaacgtggaccataagccctccaacaccaaggtggacaagcgggtggaatccaagtatggacccccctgtcctccttgccctgctcctgaatttctcggaggcccctccgtcttcctgtttccccccaagcccaaggacaccctgatgatctcccggacacccgaagtcacctgcgtcgtggtggatgtcagccaggaagatcccgaggtgcagttcaactggtacgtggacggagtggaggtgcataacgccaaaaccaagcccagggaagagcagttcaacagcacctatcgggtcgtgtccgtgctcaccgtcctgcatcaggattggctcaacggcaaggagtacaagtgcaaggtgtccaacaagggcctgccctcctccatcgagaagaccatctccaaggctaagggccaacctcgggagccccaagtgtataccctccctcccagccaggaggagatgaccaagaatcaagtgagcctgacctgcctcgtgaagggattttacccctccgacatcgctgtggaatgggaaagcaatggccaacctgagaacaactacaagaccacaccccccgtgctggactccgatggctccttcttcctgtacagcaggctgaccgtggacaaatcccggtggcaagagggaaacgtgttcagctgctccgtgatgcacgaggctctccacaaccactacacccagaagagcctctccctgagcctcggctagtaa

SEQ ID NO: 729 - DNA, 1344 bp, Artificial Sequence
  24D12.2H9 heavy chain DNA sequence
caggtgcagctgaagcagtcaggacctggcctagtgcagccctcacagagcctgtccatcacctgcacagtctctggtttctcattaactagctatggtgtacactgggttcgccaggctccaggaaagggtctggaatggctgggagtgatatggagtggtggaagcacagactataatgctgctttcatgtccagactgagcatcagcaaggacaactccaagagccaagttttctttaaaatgaacagtctgcaagctgatgacactgccatatactactgtgccaaaagccctgatggttacgacgtcgcctggtttggttactggggccaagggactctggtcactgtctctgcagctagcaccaagggccccagcgtgtttcctctcgctccctgcagccggagcacatccgagagcaccgctgctctgggctgtctcgtgaaggactacttccctgaacccgtcaccgtcagctggaatagcggcgccctgacatccggcgtccacacattccccgctgtcctgcagagcagcggcctgtacagcctgagctccgtggtcaccgtgcctagcagcagcctgggaacaaagacctacacctgcaacgtggaccataagccctccaacaccaaggtggacaagcgggtggaatccaagtatggacccccctgtcctccttgccctgctcctgaatttctcggaggcccctccgtcttcctgtttccccccaagcccaaggacaccctgatgatctcccggacacccgaagtcacctgcgtcgtggtggatgtcagccaggaagatcccgaggtgcagttcaactggtacgtggacggagtggaggtgcataacgccaaaaccaagcccagggaagagcagttcaacagcacctatcgggtcgtgtccgtgctcaccgtcctgcatcaggattggctcaacggcaaggagtacaagtgcaaggtgtccaacaagggcctgccctcctccatcgagaagaccatctccaaggctaagggccaacctcgggagccccaagtgtataccctccctcccagccaggaggagatgaccaagaatcaagtgagcctgacctgcctcgtgaagggattttacccctccgacatcgctgtggaatgggaaagcaatggccaacctgagaacaactacaagaccacaccccccgtgctggactccgatggctccttcttcctgtacagcaggctgaccgtggacaaatcccggtggcaagagggaaacgtgttcagctgctccgtgatgcacgaggctctccacaaccactacacccagaagagcctctccctgagcctcggctagtaa

SEQ ID NO: 730 - DNA, 1350 bp, Artificial Sequence
  F846C.1B2 heavy chain DNA sequence
cagatccagttggtgcagtctggacctgagctgaagaagcctggagagacagtcaagatctcctgcaaggcttctgggtataccttcacaaactatggaatgaattgggtgaagcaggctccaggaaagggtttaaagtggatgggctggataaacacctacactggagagccatcatatgctgatgacttcaagggacggtttgccttctctttggaaacctctgccagcactgcctatttgcagatcaacaacctcaaaaatgaggacatggctacatatttctgtgcaagatgggggggttacgctggggattactatgctatggacttctggggtcaaggaacctcagtcaccgtctcctcagctagcaccaagggccccagcgtgtttcctctcgctccctgcagccggagcacatccgagagcaccgctgctctgggctgtctcgtgaaggactacttccctgaacccgtcaccgtcagctggaatagcggcgccctgacatccggcgtccacacattccccgctgtcctgcagagcagcggcctgtacagcctgagctccgtggtcaccgtgcctagcagcagcctgggaacaaagacctacacctgcaacgtggaccataagccctccaacaccaaggtggacaagcgggtggaatccaagtatggacccccctgtcctccttgccctgctcctgaatttctcggaggcccctccgtcttcctgtttccccccaagcccaaggacaccctgatgatctcccggacacccgaagtcacctgcgtcgtggtggatgtcagccaggaagatcccgaggtgcagttcaactggtacgtggacggagtggaggtgcataacgccaaaaccaagcccagggaagagcagttcaacagcacctatcgggtcgtgtccgtgctcaccgtcctgcatcaggattggctcaacggcaaggagtacaagtgcaaggtgtccaacaagggcctgccctcctccatcgagaagaccatctccaaggctaagggccaacctcgggagccccaagtgtataccctccctcccagccaggaggagatgaccaagaatcaagtgagcctgacctgcctcgtgaagggattttacccctccgacatcgctgtggaatgggaaagcaatggccaacctgagaacaactacaagaccacaccccccgtgctggactccgatggctccttcttcctgtacagcaggctgaccgtggacaaatcccggtggcaagagggaaacgtgttcagctgctccgtgatgcacgaggctctccacaaccactacacccagaagagcctctccctgagcctcggctagtaa

SEQ ID NO: 731 - DNA, 1350 bp, Artificial Sequence
  F846C.1F5 heavy chain DNA sequence
cagatccagttggtgcagtctggacctgagctgaagaagcctggagagacagtcaagatctcctgcaaggcttctgggtataccttcacaaactatggaatgaactgggtgaagcaggctccaggaaagggtttaaagtggatgggctggataaacacctacactggagagccatcatatgctgatgacttcaagggacggtttgccttctctttggaaacctctgccagcactgcctatttgcagatcaacaacctcaaaaatgaggacatggctacatatttctgtgcaagatgggggggttacgatggggattactatgctatggactactggggtcaaggaacctcagtcaccgtctcctcagctagcaccaagggccccagcgtgtttcctctcgctccctgcagccggagcacatccgagagcaccgctgctctgggctgtctcgtgaaggactacttccctgaacccgtcaccgtcagctggaatagcggcgccctgacatccggcgtccacacattccccgctgtcctgcagagcagcggcctgtacagcctgagctccgtggtcaccgtgcctagcagcagcctgggaacaaagacctacacctgcaacgtggaccataagccctccaacaccaaggtggacaagcgggtggaatccaagtatggacccccctgtcctccttgccctgctcctgaatttctcggaggcccctccgtcttcctgtttccccccaagcccaaggacaccctgatgatctcccggacacccgaagtcacctgcgtcgtggtggatgtcagccaggaagatcccgaggtgcagttcaactggtacgtggacggagtggaggtgcataacgccaaaaccaagcccagggaagagcagttcaacagcacctatcgggtcgtgtccgtgctcaccgtcctgcatcaggattggctcaacggcaaggagtacaagtgcaaggtgtccaacaagggcctgccctcctccatcgagaagaccatctccaaggctaagggccaacctcgggagccccaagtgtataccctccctcccagccaggaggagatgaccaagaatcaagtgagcctgacctgcctcgtgaagggattttacccctccgacatcgctgtggaatgggaaagcaatggccaacctgagaacaactacaagaccacaccccccgtgctggactccgatggctccttcttcctgtacagcaggctgaccgtggacaaatcccggtggcaagagggaaacgtgttcagctgctccgtgatgcacgaggctctccacaaccactacacccagaagagcctctccctgagcctcggctagtaa

SEQ ID NO: 732 - DNA, 1350 bp, Artificial Sequence
  F846C.1H12 heavy chain DNA sequence
cagatccagttggtgcagtctggacctgagctgaagaagcctggagagacagtcaagatctcctgcaaggcttctgggtataccttcacaaactttggaatgaactgggtgaagcaggctccaggaaagggtttaaagtggatgggctggataaacacctacactggagagccatcatatgctgatgacttcaagggacggtttgccttctctttggaaacctctgccagcactgcctatttgcagatcaacaacctcaaaaatgaggacattgctacatatttctgtgcaagatgggggggttacgctggggattactatgctatggactactggggtcaaggaacctcagtcaccgtctcctcagctagcaccaagggccccagcgtgtttcctctcgctccctgcagccggagcacatccgagagcaccgctgctctgggctgtctcgtgaaggactacttccctgaacccgtcaccgtcagctggaatagcggcgccctgacatccggcgtccacacattccccgctgtcctgcagagcagcggcctgtacagcctgagctccgtggtcaccgtgcctagcagcagcctgggaacaaagacctacacctgcaacgtggaccataagccctccaacaccaaggtggacaagcgggtggaatccaagtatggacccccctgtcctccttgccctgctcctgaatttctcggaggcccctccgtcttcctgtttccccccaagcccaaggacaccctgatgatctcccggacacccgaagtcacctgcgtcgtggtggatgtcagccaggaagatcccgaggtgcagttcaactggtacgtggacggagtggaggtgcataacgccaaaaccaagcccagggaagagcagttcaacagcacctatcgggtcgtgtccgtgctcaccgtcctgcatcaggattggctcaacggcaaggagtacaagtgcaaggtgtccaacaagggcctgccctcctccatcgagaagaccatctccaaggctaagggccaacctcgggagccccaagtgtataccctccctcccagccaggaggagatgaccaagaatcaagtgagcctgacctgcctcgtgaagggattttacccctccgacatcgctgtggaatgggaaagcaatggccaacctgagaacaactacaagaccacaccccccgtgctggactccgatggctccttcttcctgtacagcaggctgaccgtggacaaatcccggtggcaagagggaaacgtgttcagctgctccgtgatgcacgaggctctccacaaccactacacccagaagagcctctccctgagcctcggctagtaa

SEQ ID NO: 733 - DNA, 1332 bp, Artificial Sequence
  F846C.1H5 heavy chain DNA sequence
gaggtccagctgttggagtctgggggaggcttagtgaagcctggagggtccctgaaactctcctgtgcagcctctggattcactttcagcagctatgccatgtcttgggttcgccagactccagagaagaggctggagtgggtcgcatccattagtagtggtggtgacacctactatccagacagtgtgaagggccgattcaccatctctagagataatgccaggaacatcctgtacctgcaaatgagcagtctgaggtctgaggacacggccatgtattactgtgcaagttatggtaactccctctttgactactggggccaaggcaccactctcacagtctcctcagctagcaccaagggccccagcgtgtttcctctcgctccctgcagccggagcacatccgagagcaccgctgctctgggctgtctcgtgaaggactacttccctgaacccgtcaccgtcagctggaatagcggcgccctgacatccggcgtccacacattccccgctgtcctgcagagcagcggcctgtacagcctgagctccgtggtcaccgtgcctagcagcagcctgggaacaaagacctacacctgcaacgtggaccataagccctccaacaccaaggtggacaagcgggtggaatccaagtatggacccccctgtcctccttgccctgctcctgaatttctcggaggcccctccgtcttcctgtttccccccaagcccaaggacaccctgatgatctcccggacacccgaagtcacctgcgtcgtggtggatgtcagccaggaagatcccgaggtgcagttcaactggtacgtggacggagtggaggtgcataacgccaaaaccaagcccagggaagagcagttcaacagcacctatcgggtcgtgtccgtgctcaccgtcctgcatcaggattggctcaacggcaaggagtacaagtgcaaggtgtccaacaagggcctgccctcctccatcgagaagaccatctccaaggctaagggccaacctcgggagccccaagtgtataccctccctcccagccaggaggagatgaccaagaatcaagtgagcctgacctgcctcgtgaagggattttacccctccgacatcgctgtggaatgggaaagcaatggccaacctgagaacaactacaagaccacaccccccgtgctggactccgatggctccttcttcctgtacagcaggctgaccgtggacaaatcccggtggcaagagggaaacgtgttcagctgctccgtgatgcacgaggctctccacaaccactacacccagaagagcctctccctgagcctcggctagtaa

SEQ ID NO: 734 - DNA, 1350 bp, Artificial Sequence; identical to SEQ ID NO: 731
  F846C.2H3 heavy chain DNA sequence

SEQ ID NO: 735 - DNA, 1326 bp, Artificial Sequence
  F846TC.14A2 heavy chain DNA sequence
cagatccagttggtgcagtctggacctgagctgaagaagcctggagagacagtcaagatctcctgcaaggcttctgggtataccttcacaaactatggaatgaactgggtgaagcaggctccaggaaagggtttaaagtggatgggctggataaacacctacactggagagccaacatatgctggtgacctcaagggacggtttgccttctctttggaaacctctgccagcactgcctatttgcagatcaacaacctcaaaaatgaggacacggctacatatttctgtgtaagatatactatggactactggggtcaaggaacctcagtcaccgtctcctcagctagcaccaagggccccagcgtgtttcctctcgctccctgcagccggagcacatccgagagcaccgctgctctgggctgtctcgtgaaggactacttccctgaacccgtcaccgtcagctggaatagcggcgccctgacatccggcgtccacacattccccgctgtcctgcagagcagcggcctgtacagcctgagctccgtggtcaccgtgcctagcagcagcctgggaacaaagacctacacctgcaacgtggaccataagccctccaacaccaaggtggacaagcgggtggaatccaagtatggacccccctgtcctccttgccctgctcctgaatttctcggaggcccctccgtcttcctgtttccccccaagcccaaggacaccctgatgatctcccggacacccgaagtcacctgcgtcgtggtggatgtcagccaggaagatcccgaggtgcagttcaactggtacgtggacggagtggaggtgcataacgccaaaaccaagcccagggaagagcagttcaacagcacctatcgggtcgtgtccgtgctcaccgtcctgcatcaggattggctcaacggcaaggagtacaagtgcaaggtgtccaacaagggcctgccctcctccatcgagaagaccatctccaaggctaagggccaacctcgggagccccaagtgtataccctccctcccagccaggaggagatgaccaagaatcaagtgagcctgacctgcctcgtgaagggattttacccctccgacatcgctgtggaatgggaaagcaatggccaacctgagaacaactacaagaccacaccccccgtgctggactccgatggctccttcttcctgtacagcaggctgaccgtggacaaatcccggtggcaagagggaaacgtgttcagctgctccgtgatgcacgaggctctccacaaccactacacccagaagagcctctccctgagcctcggctagtaa

SEQ ID NO: 736 - DNA, 1356 bp, Artificial Sequence
  F846TC.14E4 heavy chain DNA sequence
caggttactctgaaagagtctggccctgggatattgcagccctcccagaccctcagtctgacttgttctttctctgggttttcactgagcacttctggtatgggtgtaggctggattcgtcagccttcagggaagggtctggagtggctggcacacatttggtgggatgatgataagtactataacacagccctgaagagcgggctcacaatctccaaggatgcctccaaaaaccaggtcttcctcaagatcgccagtatggacactgcagatactgccacatactactgtgctcgaaacctctatgatggttcctacgggtactatgctatggactactggggtcaaggaacctcagtcaccgtctcctcagctagcaccaagggccccagcgtgtttcctctcgctccctgcagccggagcacatccgagagcaccgctgctctgggctgtctcgtgaaggactacttccctgaacccgtcaccgtcagctggaatagcggcgccctgacatccggcgtccacacattccccgctgtcctgcagagcagcggcctgtacagcctgagctccgtggtcaccgtgcctagcagcagcctgggaacaaagacctacacctgcaacgtggaccataagccctccaacaccaaggtggacaagcgggtggaatccaagtatggacccccctgtcctccttgccctgctcctgaatttctcggaggcccctccgtcttcctgtttccccccaagcccaaggacaccctgatgatctcccggacacccgaagtcacctgcgtcgtggtggatgtcagccaggaagatcccgaggtgcagttcaactggtacgtggacggagtggaggtgcataacgccaaaaccaagcccagggaagagcagttcaacagcacctatcgggtcgtgtccgtgctcaccgtcctgcatcaggattggctcaacggcaaggagtacaagtgcaaggtgtccaacaagggcctgccctcctccatcgagaagaccatctccaaggctaagggccaacctcgggagccccaagtgtataccctccctcccagccaggaggagatgaccaagaatcaagtgagcctgacctgcctcgtgaagggattttacccctccgacatcgctgtggaatgggaaagcaatggccaacctgagaacaactacaagaccacaccccccgtgctggactccgatggctccttcttcctgtacagcaggctgaccgtggacaaatcccggtggcaagagggaaacgtgttcagctgctccgtgatgcacgaggctctccacaaccactacacccagaagagcctctccctgagcctcggctagtaa

SEQ ID NO: 737 - DNA, 1350 bp, Artificial Sequence
  F846TC.16B5 heavy chain DNA sequence
cagatccagttggtgcagtctggacctgagctgaagaagcctggagagacagtcaagatctcctgcaaggcttctgggtataccttcacaaactatggaatgaactgggtgaagcaggctccaggaaagggtttaaagtggatgggctggataaacacctacactggagagccagcatatgctgatgacttcaagggacggtttgccttctctttggaaacctctgccagcactgcctatttgcagatcaacaacctcaaaaatgaggacatggctacatatttctgtgcaagatgggggggttacgatggggattactatgctatggactactggggtcaaggaacctcagtcaccgtctcctcagctagcaccaagggccccagcgtgtttcctctcgctccctgcagccggagcacatccgagagcaccgctgctctgggctgtctcgtgaaggactacttccctgaacccgtcaccgtcagctggaatagcggcgccctgacatccggcgtccacacattccccgctgtcctgcagagcagcggcctgtacagcctgagctccgtggtcaccgtgcctagcagcagcctgggaacaaagacctacacctgcaacgtggaccataagccctccaacaccaaggtggacaagcgggtggaatccaagtatggacccccctgtcctccttgccctgctcctgaatttctcggaggcccctccgtcttcctgtttccccccaagcccaaggacaccctgatgatctcccggacacccgaagtcacctgcgtcgtggtggatgtcagccaggaagatcccgaggtgcagttcaactggtacgtggacggagtggaggtgcataacgccaaaaccaagcccagggaagagcagttcaacagcacctatcgggtcgtgtccgtgctcaccgtcctgcatcaggattggctcaacggcaaggagtacaagtgcaaggtgtccaacaagggcctgccctcctccatcgagaagaccatctccaaggctaagggccaacctcgggagccccaagtgtataccctccctcccagccaggaggagatgaccaagaatcaagtgagcctgacctgcctcgtgaagggattttacccctccgacatcgctgtggaatgggaaagcaatggccaacctgagaacaactacaagaccacaccccccgtgctggactccgatggctccttcttcctgtacagcaggctgaccgtggacaaatcccggtggcaagagggaaacgtgttcagctgctccgtgatgcacgaggctctccacaaccactacacccagaagagcctctccctgagcctcggctagtaa

SEQ ID NO: 738 - DNA, 1353 bp, Artificial Sequence
  F846TC.7F10 heavy chain DNA sequence
gaagtgcagctggtggagtctgggggagacttagtgaagcctggagggtccctgaaactctcctgtgcagcctctggattcactttcagtaactatggcttgtcttggattcgccagactccagacaagaggctggagtgggtcgcaaccattagtagtggtggtagttacacctactatcctgacagtgtgaaggggcgattcaccatctccagagacagtgccaagaacaccctgtacctgcaaatgagcagtctgaagtctgaggacacagccatgtattactgtgcaagacatgcgcattactacggtgttagcccgtactactttgactactggggccaaggcacctgtctcacagtctcctcagctagcaccaagggccccagcgtgtttcctctcgctccctgcagccggagcacatccgagagcaccgctgctctgggctgtctcgtgaaggactacttccctgaacccgtcaccgtcagctggaatagcggcgccctgacatccggcgtccacacattccccgctgtcctgcagagcagcggcctgtacagcctgagctccgtggtcaccgtgcctagcagcagcctgggaacaaagacctacacctgcaacgtggaccataagccctccaacaccaaggtggacaagcgggtggaatccaagtatggacccccctgtcctccttgccctgctcctgaatttctcggaggcccctccgtcttcctgtttccccccaagcccaaggacaccctgatgatctcccggacacccgaagtcacctgcgtcgtggtggatgtcagccaggaagatcccgaggtgcagttcaactggtacgtggacggagtggaggtgcataacgccaaaaccaagcccagggaagagcagttcaacagcacctatcgggtcgtgtccgtgctcaccgtcctgcatcaggattggctcaacggcaaggagtacaagtgcaaggtgtccaacaagggcctgccctcctccatcgagaagaccatctccaaggctaagggccaacctcgggagccccaagtgtataccctccctcccagccaggaggagatgaccaagaatcaagtgagcctgacctgcctcgtgaagggattttacccctccgacatcgctgtggaatgggaaagcaatggccaacctgagaacaactacaagaccacaccccccgtgctggactccgatggctccttcttcctgtacagcaggctgaccgtggacaaatcccggtggcaagagggaaacgtgttcagctgctccgtgatgcacgaggctctccacaaccactacacccagaagagcctctccctgagcctcggctagtaa

SEQ ID NO: 739 - DNA, 1341 bp, Artificial Sequence
  F847C.10B9 heavy chain DNA sequence
cagatccagttggtgcagtctggacctgaggtgaagaagcctggagagacagtcaagatctcctgcaaggcttctgggtatatcttcacaaactatggaatgaactgggtgaagcaggctccaggaaagggtttaaagtggatgggctggataaacacctacactggagagccaacatatactgatgacttcaagggacggtttgccttctctttggaaacctctgccagcactgcctatttgcagatcaacaacctcaaaaatgaggacacggctacatatttctgtgcaaagtttggtaactacgtgggagctatggactactggggtcaaggaacctcagtcaccgtctcctcagctagcaccaagggccccagcgtgtttcctctcgctccctgcagccggagcacatccgagagcaccgctgctctgggctgtctcgtgaaggactacttccctgaacccgtcaccgtcagctggaatagcggcgccctgacatccggcgtccacacattccccgctgtcctgcagagcagcggcctgtacagcctgagctccgtggtcaccgtgcctagcagcagcctgggaacaaagacctacacctgcaacgtggaccataagccctccaacaccaaggtggacaagcgggtggaatccaagtatggacccccctgtcctccttgccctgctcctgaatttctcggaggcccctccgtcttcctgtttccccccaagcccaaggacaccctgatgatctcccggacacccgaagtcacctgcgtcgtggtggatgtcagccaggaagatcccgaggtgcagttcaactggtacgtggacggagtggaggtgcataacgccaaaaccaagcccagggaagagcagttcaacagcacctatcgggtcgtgtccgtgctcaccgtcctgcatcaggattggctcaacggcaaggagtacaagtgcaaggtgtccaacaagggcctgccctcctccatcgagaagaccatctccaaggctaagggccaacctcgggagccccaagtgtataccctccctcccagccaggaggagatgaccaagaatcaagtgagcctgacctgcctcgtgaagggattttacccctccgacatcgctgtggaatgggaaagcaatggccaacctgagaacaactacaagaccacaccccccgtgctggactccgatggctccttcttcctgtacagcaggctgaccgtggacaaatcccggtggcaagagggaaacgtgttcagctgctccgtgatgcacgaggctctccacaaccactacacccagaagagcctctccctgagcctcggctagtaa

SEQ ID NO: 740 - DNA, 1344 bp, Artificial Sequence
  F847C.11B1 heavy chain DNA sequence
gaggtccagcttcagcagtctggacctgagctggtgaaacctggggcctcagtgaagatatcctgcaaggcttctggaaacacattcactgaccacaacatgcactgggtgaagcagagccatggaaagagccttgagtggattggatatatttatccttacaatggtggtactggctacaaccagaagttcaagagcaaggccacattgactgtagacaattcctccagcacagtctacatggagctccgcagcctgacatctgaggactctgcagtctattactgtgcaagaggggagtatgattacctggcctggtttgcttactggggccaagggactctggtcactgtctctgcagctagcaccaagggccccagcgtgtttcctctcgctccctgcagccggagcacatccgagagcaccgctgctctgggctgtctcgtgaaggactacttccctgaacccgtcaccgtcagctggaatagcggcgccctgacatccggcgtccacacattccccgctgtcctgcagagcagcggcctgtacagcctgagctccgtggtcaccgtgcctagcagcagcctgggaacaaagacctacacctgcaacgtggaccataagccctccaacaccaaggtggacaagcgggtggaatccaagtatggacccccctgtcctccttgccctgctcctgaatttctcggaggcccctccgtcttcctgtttccccccaagcccaaggacaccctgatgatctcccggacacccgaagtcacctgcgtcgtggtggatgtcagccaggaagatcccgaggtgcagttcaactggtacgtggacggagtggaggtgcataacgccaaaaccaagcccagggaagagcagttcaacagcacctatcgggtcgtgtccgtgctcaccgtcctgcatcaggattggctcaacggcaaggagtacaagtgcaaggtgtccaacaagggcctgccctcctccatcgagaagaccatctccaaggctaagggccaacctcgggagccccaagtgtataccctccctcccagccaggaggagatgaccaagaatcaagtgagcctgacctgcctcgtgaagggattttacccctccgacatcgctgtggaatgggaaagcaatggccaacctgagaacaactacaagaccacaccccccgtgctggactccgatggctccttcttcctgtacagcaggctgaccgtggacaaatcccggtggcaagagggaaacgtgttcagctgctccgtgatgcacgaggctctccacaaccactacacccagaagagcctctccctgagcctcggctagtaa

SEQ ID NO: 741 - DNA, 1341 bp, Artificial Sequence
  F847C.12F12 heavy chain DNA sequence
cagatccagttggtgcagtctggacctgagctgaagaagcctggagagacagtcaagatctcctgcaaggcttctgggtataccttcacaaactatggaatgaactgggtgaagcaggctccaggaaagggtttaaagtggatgggctggataaacacctacactggagagccaacatatgttgatgacttcaagggacggtttgccttctctttggaaacctctgccagcactgcctatttgcggatcaacaacctcaaaaatgaggacacggctacatatttctgtgcaaagtttggtaactacgtgggagctatggactactggggtcaaggaacctcagtcaccgtctcctcagctagcaccaagggccccagcgtgtttcctctcgctccctgcagccggagcacatccgagagcaccgctgctctgggctgtctcgtgaaggactacttccctgaacccgtcaccgtcagctggaatagcggcgccctgacatccggcgtccacacattccccgctgtcctgcagagcagcggcctgtacagcctgagctccgtggtcaccgtgcctagcagcagcctgggaacaaagacctacacctgcaacgtggaccataagccctccaacaccaaggtggacaagcgggtggaatccaagtatggacccccctgtcctccttgccctgctcctgaatttctcggaggcccctccgtcttcctgtttccccccaagcccaaggacaccctgatgatctcccggacacccgaagtcacctgcgtcgtggtggatgtcagccaggaagatcccgaggtgcagttcaactggtacgtggacggagtggaggtgcataacgccaaaaccaagcccagggaagagcagttcaacagcacctatcgggtcgtgtccgtgctcaccgtcctgcatcaggattggctcaacggcaaggagtacaagtgcaaggtgtccaacaagggcctgccctcctccatcgagaagaccatctccaaggctaagggccaacctcgggagccccaagtgtataccctccctcccagccaggaggagatgaccaagaatcaagtgagcctgacctgcctcgtgaagggattttacccctccgacatcgctgtggaatgggaaagcaatggccaacctgagaacaactacaagaccacaccccccgtgctggactccgatggctccttcttcctgtacagcaggctgaccgtggacaaatcccggtggcaagagggaaacgtgttcagctgctccgtgatgcacgaggctctccacaaccactacacccagaagagcctctccctgagcctcggctagtaa

SEQ ID NO: 742 - DNA, 1341 bp, Artificial Sequence; identical to SEQ ID NO: 739
  F847C.26F5 heavy chain DNA sequence

SEQ ID NO: 743 - DNA, 1335 bp, Artificial Sequence
  F847C.4B10 heavy chain DNA sequence
gaggtgcagcttgttgagactgggggaggcttagtgaagcctggagggtccctgaaactctcctgtgcagcctctggattcactttcagtagctatgccatgtcttgggttcgccagactccagagaagaggctggagtgggtcgcatccattagtagtggtggtagcacctactatccagacagtgtgaagggccgattcaccatctccagagataatgccaggaacatcctgtacctgcaaatgagcagtctgaggtctgaggacacggccatgtattactgtacaaggtttactacggtagtagagatggactactggggtcaaggaacctcagtcaccgtctcctcagctagcaccaagggccccagcgtgtttcctctcgctccctgcagccggagcacatccgagagcaccgctgctctgggctgtctcgtgaaggactacttccctgaacccgtcaccgtcagctggaatagcggcgccctgacatccggcgtccacacattccccgctgtcctgcagagcagcggcctgtacagcctgagctccgtggtcaccgtgcctagcagcagcctgggaacaaagacctacacctgcaacgtggaccataagccctccaacaccaaggtggacaagcgggtggaatccaagtatggacccccctgtcctccttgccctgctcctgaatttctcggaggcccctccgtcttcctgtttccccccaagcccaaggacaccctgatgatctcccggacacccgaagtcacctgcgtcgtggtggatgtcagccaggaagatcccgaggtgcagttcaactggtacgtggacggagtggaggtgcataacgccaaaaccaagcccagggaagagcagttcaacagcacctatcgggtcgtgtccgtgctcaccgtcctgcatcaggattggctcaacggcaaggagtacaagtgcaaggtgtccaacaagggcctgccctcctccatcgagaagaccatctccaaggctaagggccaacctcgggagccccaagtgtataccctccctcccagccaggaggagatgaccaagaatcaagtgagcctgacctgcctcgtgaagggattttacccctccgacatcgctgtggaatgggaaagcaatggccaacctgagaacaactacaagaccacaccccccgtgctggactccgatggctccttcttcctgtacagcaggctgaccgtggacaaatcccggtggcaagagggaaacgtgttcagctgctccgtgatgcacgaggctctccacaaccactacacccagaagagcctctccctgagcctcggctagtaa

SEQ ID NO: 744 - DNA, 1320 bp, Artificial Sequence
  F849C.8D10 heavy chain DNA sequence
caggtccaactgcagcagactggtgctgagcttgtgaagcctggggcctcagtgaagctgtcctgcaaggcttctggctatactttcaccagctactggataaactgggtgaagcagaggcctggacaaggccttgagtggattggaaacatttatcctggtagtagtagtatttactacagtgagaagttcaagagtaaggccacactgactgtagacacatcctccagcacagcctacatgcagctcagcagcctgacatctgacgactctgcggtctattattgtgcaagatggggctactggggccaaggcaccactctcacagtctcctcagctagcaccaagggccccagcgtgtttcctctcgctccctgcagccggagcacatccgagagcaccgctgctctgggctgtctcgtgaaggactacttccctgaacccgtcaccgtcagctggaatagcggcgccctgacatccggcgtccacacattccccgctgtcctgcagagcagcggcctgtacagcctgagctccgtggtcaccgtgcctagcagcagcctgggaacaaagacctacacctgcaacgtggaccataagccctccaacaccaaggtggacaagcgggtggaatccaagtatggacccccctgtcctccttgccctgctcctgaatttctcggaggcccctccgtcttcctgtttccccccaagcccaaggacaccctgatgatctcccggacacccgaagtcacctgcgtcgtggtggatgtcagccaggaagatcccgaggtgcagttcaactggtacgtggacggagtggaggtgcataacgccaaaaccaagcccagggaagagcagttcaacagcacctatcgggtcgtgtccgtgctcaccgtcctgcatcaggattggctcaacggcaaggagtacaagtgcaaggtgtccaacaagggcctgccctcctccatcgagaagaccatctccaaggctaagggccaacctcgggagccccaagtgtataccctccctcccagccaggaggagatgaccaagaatcaagtgagcctgacctgcctcgtgaagggattttacccctccgacatcgctgtggaatgggaaagcaatggccaacctgagaacaactacaagaccacaccccccgtgctggactccgatggctccttcttcctgtacagcaggctgaccgtggacaaatcccggtggcaagagggaaacgtgttcagctgctccgtgatgcacgaggctctccacaaccactacacccagaagagcctctccctgagcctcggctagtaa

SEQ ID NO: 745 - DNA, 1347 bp, Artificial Sequence
  F849C.8H3 heavy chain DNA sequence
caggttactctgaaagagtctggccctgggatattgcagccctcccagaccctcagtctgacttgttctttctctgggttttcactgagcacttttggtatgggtgtaggctggattcgtcagccttcagggaagggtctggagtggctggcacacatttggtgggatgatgataaacactataacccagccctgaagagccggctcacaatctccaaggatacctccaaaaaccaggtcttcctcaggatcgccaatgtggacactgcagataatgccacatattactgtgctcgaatcgactatggtgactacgtcgggtttgcttattggggccaagggactctggtcactgtctctgcagctagcaccaagggccccagcgtgtttcctctcgctccctgcagccggagcacatccgagagcaccgctgctctgggctgtctcgtgaaggactacttccctgaacccgtcaccgtcagctggaatagcggcgccctgacatccggcgtccacacattccccgctgtcctgcagagcagcggcctgtacagcctgagctccgtggtcaccgtgcctagcagcagcctgggaacaaagacctacacctgcaacgtggaccataagccctccaacaccaaggtggacaagcgggtggaatccaagtatggacccccctgtcctccttgccctgctcctgaatttctcggaggcccctccgtcttcctgtttccccccaagcccaaggacaccctgatgatctcccggacacccgaagtcacctgcgtcgtggtggatgtcagccaggaagatcccgaggtgcagttcaactggtacgtggacggagtggaggtgcataacgccaaaaccaagcccagggaagagcagttcaacagcacctatcgggtcgtgtccgtgctcaccgtcctgcatcaggattggctcaacggcaaggagtacaagtgcaaggtgtccaacaagggcctgccctcctccatcgagaagaccatctccaaggctaagggccaacctcgggagccccaagtgtataccctccctcccagccaggaggagatgaccaagaatcaagtgagcctgacctgcctcgtgaagggattttacccctccgacatcgctgtggaatgggaaagcaatggccaacctgagaacaactacaagaccacaccccccgtgctggactccgatggctccttcttcctgtacagcaggctgaccgtggacaaatcccggtggcaagagggaaacgtgttcagctgctccgtgatgcacgaggctctccacaaccactacacccagaagagcctctccctgagcctcggctagtaa

SEQ ID NO: 746 - DNA, 1338 bp, Artificial Sequence
  846.2B11 heavy chain DNA sequence
caggtccagctacagcagtctggacctgagctggtgaggcctggggctttagtgaagatttcctgcaaggcttctggttacaccttcacaagctacgatataaactgggtgaagcagaggcctggacagggacttgagtggattggatggatttatcctggagatggtagtactaaatataatgagaaattcaagggcaaggccacactgactgcagacaaatcctccagcacagcctacatgcagctcagcagcctgacttctgagaactctgcagtctatttctgtgcaagagaggcggcttctaatgctatggactactggggtcaaggaacctcagtcaccgtctcctcagctagcaccaagggccccagcgtgtttcctctcgctccctgcagccggagcacatccgagagcaccgctgctctgggctgtctcgtgaaggactacttccctgaacccgtcaccgtcagctggaatagcggcgccctgacatccggcgtccacacattccccgctgtcctgcagagcagcggcctgtacagcctgagctccgtggtcaccgtgcctagcagcagcctgggaacaaagacctacacctgcaacgtggaccataagccctccaacaccaaggtggacaagcgggtggaatccaagtatggacccccctgtcctccttgccctgctcctgaatttctcggaggcccctccgtcttcctgtttccccccaagcccaaggacaccctgatgatctcccggacacccgaagtcacctgcgtcgtggtggatgtcagccaggaagatcccgaggtgcagttcaactggtacgtggacggagtggaggtgcataacgccaaaaccaagcccagggaagagcagttcaacagcacctatcgggtcgtgtccgtgctcaccgtcctgcatcaggattggctcaacggcaaggagtacaagtgcaaggtgtccaacaagggcctgccctcctccatcgagaagaccatctccaaggctaagggccaacctcgggagccccaagtgtataccctccctcccagccaggaggagatgaccaagaatcaagtgagcctgacctgcctcgtgaagggattttacccctccgacatcgctgtggaatgggaaagcaatggccaacctgagaacaactacaagaccacaccccccgtgctggactccgatggctccttcttcctgtacagcaggctgaccgtggacaaatcccggtggcaagagggaaacgtgttcagctgctccgtgatgcacgaggctctccacaaccactacacccagaagagcctctccctgagcctcggctagtaa

SEQ ID NO: 747 - DNA, 1350 bp, Artificial Sequence
  846.4D5 heavy chain DNA sequence
gaagtgaagcttgaggagtctggaggaggcttggtgcaacctggaggatccatgaaactctcctgtgttgcctctggattcactttcagtaactactggatgaactgggtccgccagtctccagagaaggggcttgagtgggttgctgaaattagattgaaatctaataattatgcaacacattatgcggagtctgtgaaagggaggttcaccatctcaagagatgattccaaaagtagtgtctacctgcaaatgaacaacttaagagctgaagacactggcatttattactgtaccaggcactacggctttccctactggtacttcgatgtctggggcgcagggaccacggtcaccgtctcctcagctagcaccaagggccccagcgtgtttcctctcgctccctgcagccggagcacatccgagagcaccgctgctctgggctgtctcgtgaaggactacttccctgaacccgtcaccgtcagctggaatagcggcgccctgacatccggcgtccacacattccccgctgtcctgcagagcagcggcctgtacagcctgagctccgtggtcaccgtgcctagcagcagcctgggaacaaagacctacacctgcaacgtggaccataagccctccaacaccaaggtggacaagcgggtggaatccaagtatggacccccctgtcctccttgccctgctcctgaatttctcggaggcccctccgtcttcctgtttccccccaagcccaaggacaccctgatgatctcccggacacccgaagtcacctgcgtcgtggtggatgtcagccaggaagatcccgaggtgcagttcaactggtacgtggacggagtggaggtgcataacgccaaaaccaagcccagggaagagcagttcaacagcacctatcgggtcgtgtccgtgctcaccgtcctgcatcaggattggctcaacggcaaggagtacaagtgcaaggtgtccaacaagggcctgccctcctccatcgagaagaccatctccaaggctaagggccaacctcgggagccccaagtgtataccctccctcccagccaggaggagatgaccaagaatcaagtgagcctgacctgcctcgtgaagggattttacccctccgacatcgctgtggaatgggaaagcaatggccaacctgagaacaactacaagaccacaccccccgtgctggactccgatggctccttcttcctgtacagcaggctgaccgtggacaaatcccggtggcaagagggaaacgtgttcagctgctccgtgatgcacgaggctctccacaaccactacacccagaagagcctctccctgagcctcggctagtaa

SEQ ID NO: 748 - DNA, 1338 bp, Artificial Sequence
  846T.1H2 heavy chain DNA sequence
cagatccagttggtgcagtctggacctgagctgaagaagcctggagagacagtcaagatctcctgcaaggcttctgggtataccttcacaaactatggaatgaactgggtgaagcaggctccaggaaagggtttaaagtggatgggctggataaacaccaacactggagagccaacatatgctgaagagttcaagggacggtttgccttctctttggaaacctctgccagcactgcctatttgcagatcaacaacctcaaaaatgaggacacggctacatatttctgtgcaaccggggggggtaactgggactttgactactggggccaaggcaccactctcacagtctcctcagctagcaccaagggccccagcgtgtttcctctcgctccctgcagccggagcacatccgagagcaccgctgctctgggctgtctcgtgaaggactacttccctgaacccgtcaccgtcagctggaatagcggcgccctgacatccggcgtccacacattccccgctgtcctgcagagcagcggcctgtacagcctgagctccgtggtcaccgtgcctagcagcagcctgggaacaaagacctacacctgcaacgtggaccataagccctccaacaccaaggtggacaagcgggtggaatccaagtatggacccccctgtcctccttgccctgctcctgaatttctcggaggcccctccgtcttcctgtttccccccaagcccaaggacaccctgatgatctcccggacacccgaagtcacctgcgtcgtggtggatgtcagccaggaagatcccgaggtgcagttcaactggtacgtggacggagtggaggtgcataacgccaaaaccaagcccagggaagagcagttcaacagcacctatcgggtcgtgtccgtgctcaccgtcctgcatcaggattggctcaacggcaaggagtacaagtgcaaggtgtccaacaagggcctgccctcctccatcgagaagaccatctccaaggctaagggccaacctcgggagccccaagtgtataccctccctcccagccaggaggagatgaccaagaatcaagtgagcctgacctgcctcgtgaagggattttacccctccgacatcgctgtggaatgggaaagcaatggccaacctgagaacaactacaagaccacaccccccgtgctggactccgatggctccttcttcctgtacagcaggctgaccgtggacaaatcccggtggcaagagggaaacgtgttcagctgctccgtgatgcacgaggctctccacaaccactacacccagaagagcctctccctgagcctcggctagtaa

SEQ ID NO: 749 - DNA, 1326 bp, Artificial Sequence
  847.14H4 heavy chain DNA sequence
cagatccagttggtgcagtctggacctgaactgacgaagcctggagagacagtcaagatctcctgtaaggcttctggctataccttcacagactatggaatgaactgggtgaggcaggctccaggagagactttaaagtggatgggctggataaacacctacactggagagccaacatatgctgatgacttcaaggggcggtttgccttctctttggaatcctctgccagcactgcctatttgcagatcaacaacctcaaaaatgaggacgtggctacatatttctgtgcaagataccctatggactactggggtcaaggaacctcagtcaccgtctcctcagctagcaccaagggccccagcgtgtttcctctcgctccctgcagccggagcacatccgagagcaccgctgctctgggctgtctcgtgaaggactacttccctgaacccgtcaccgtcagctggaatagcggcgccctgacatccggcgtccacacattccccgctgtcctgcagagcagcggcctgtacagcctgagctccgtggtcaccgtgcctagcagcagcctgggaacaaagacctacacctgcaacgtggaccataagccctccaacaccaaggtggacaagcgggtggaatccaagtatggacccccctgtcctccttgccctgctcctgaatttctcggaggcccctccgtcttcctgtttccccccaagcccaaggacaccctgatgatctcccggacacccgaagtcacctgcgtcgtggtggatgtcagccaggaagatcccgaggtgcagttcaactggtacgtggacggagtggaggtgcataacgccaaaaccaagcccagggaagagcagttcaacagcacctatcgggtcgtgtccgtgctcaccgtcctgcatcaggattggctcaacggcaaggagtacaagtgcaaggtgtccaacaagggcctgccctcctccatcgagaagaccatctccaaggctaagggccaacctcgggagccccaagtgtataccctccctcccagccaggaggagatgaccaagaatcaagtgagcctgacctgcctcgtgaagggattttacccctccgacatcgctgtggaatgggaaagcaatggccaacctgagaacaactacaagaccacaccccccgtgctggactccgatggctccttcttcctgtacagcaggctgaccgtggacaaatcccggtggcaagagggaaacgtgttcagctgctccgtgatgcacgaggctctccacaaccactacacccagaagagcctctccctgagcctcggctagtaa

SEQ ID NO: 750 - DNA, 663 bp, Artificial Sequence
  TB001 light chain DNA sequence
gacatcgtgctgacccagtctccactgagcctgcctgttacacctggcgagccagcctccatctcctgcagatcctctaagtccctgctgtacaaggacggcaagacctacctgaactggttcctgcagaagcccggccagtctcctcagctcctgatctacctgatgagcacccatgcctctggcgtgcccgatagattttccggctctggctctggcaccgacttcaccctgaagatctccagagtggaagccgaggacgtgggcgtgtactactgtcagcagctggtggactaccctctgacctttggcggcggaacaaagctggaaatcaagcggacagtggccgctccttccgtgttcatcttcccaccttccgacgagcagctgaagtccggcacagcttctgtcgtgtgcctgctgaacaacttctaccctcgggaagccaaggtgcagtggaaggtggacaatgccctgcagtccggcaactcccaagagtctgtgaccgagcaggactccaaggacagcacctacagcctgtcctccacactgaccctgtccaaggccgactacgagaagcacaaggtgtacgcctgcgaagtgacccatcagggcctgtctagccctgtgaccaagtctttcaaccggggcgagtgctgatga

SEQ ID NO: 751 - DNA, 660 bp, Artificial Sequence
  TB006 light chain DNA sequence
gatatagtgatgacccaaacacctttgtccctgtcagtcaccccaggccaacccgcatctatctcatgcaaatcctcaaaaagtcttttgcactctgacgggataacatatctctactggtatcttcaaaaacctggtcagtccccccagctcttgatctatagaatgagtaaccttgcctctggtgtccccgaccggtttagtggaagcgggtctgggaccgacttcaccctcaagattagtcgcgtcgaagccgaagatgtgggagtgtattactgtgcccagatgctcgaatttcccctgacatttggtcaaggaactaaattggagattaagcggaccgtggccgcccccagcgtgttcatcttccctcccagcgacgagcagctgaagtctggcaccgccagcgtggtgtgcctgctgaacaacttctacccccgcgaggccaaggtgcagtggaaggtggacaacgccctgcagagcggcaacagccaggagagcgtgaccgagcaggactccaaggacagcacctacagcctgagcagcaccctgaccctgagcaaggccgactacgagaagcacaaggtgtacgcctgcgaggtgacccaccagggactgtctagccccgtgaccaagagcttcaaccggggcgagtgctaa

SEQ ID NO: 752 - DNA, 645 bp, Artificial Sequence
  12G5.D7 light chain DNA sequence
gacatcctgatgacccaatctccatcctccatgtctgtatctctgggagacacagtcagcatcacttgccatgcaagtcagggcattaactctaatatggggtggttgcagcagaaaccagggaaatcatttaagggcctgatctatcatgcaaccaacttggaagatggagttccatcaaggttcagtggcagtggatctggagcagattattctctcaccatcagcagcctggaatctgaagattttgcagactattactgtgtacagtatgctcagtttcctcctacgttcggatcggggaccaagctggaaataaaacggaccgtggccgcccccagcgtgttcatcttccctcccagcgacgagcagctgaagtctggcaccgccagcgtggtgtgcctgctgaacaacttctacccccgcgaggccaaggtgcagtggaaggtggacaacgccctgcagagcggcaacagccaggagagcgtgaccgagcaggactccaaggacagcacctacagcctgagcagcaccctgaccctgagcaaggccgactacgagaagcacaaggtgtacgcctgcgaggtgacccaccagggactgtctagccccgtgaccaagagcttcaaccggggcgagtgctaa

SEQ ID NO: 753 - DNA, 660 bp, Artificial Sequence
  13A12.2E5 light chain DNA sequence
gatgttgtgatgacccagactccactcactttgtcggttgccattggacaaccagcttccatctcttgcaagtcgagtcagagcctcttatatactaatggaaaaacctatttgaattggttattacagaggccaggccagtctccaaaacgcctaatctatctgctgtctaaattggactctggagtccctgacaggttcagtgccagtggatcagggacagatttcacactgaaaatcagcagagtggaggctgaggatttgggagtttattactgcttgcagagtacacattttccgctcacgttcggtgctgggaccaagctggagatgaaacggaccgtggccgcccccagcgtgttcatcttccctcccagcgacgagcagctgaagtctggcaccgccagcgtggtgtgcctgctgaacaacttctacccccgcgaggccaaggtgcagtggaaggtggacaacgccctgcagagcggcaacagccaggagagcgtgaccgagcaggactccaaggacagcacctacagcctgagcagcaccctgaccctgagcaaggccgactacgagaagcacaaggtgtacgcctgcgaggtgacccaccagggactgtctagccccgtgaccaagagcttcaaccggggcgagtgctaa

SEQ ID NO: 754 - DNA, 660 bp, Artificial Sequence
  14H10.2C9 light chain DNA sequence
gatgttgtgatgacccagactccactcactttgtcggttaccattggacaaccagcctccatctcttgcaagtcaagtcagagcctcttcgatagtgatggaaagacatatttgaattggttgttacagaggccaggccagtctccaaagcgcctaatctatctggtgtctaaactggactctggagtccctgacaggttcactggcagtggatcagggacagatttcacactgaaaatcagcagagtggaggctgaggatttgggagtttattattgctggcaaggtacacattttcctctcacgttcggtgctgggaccaagctggaaatgaaacggaccgtggccgcccccagcgtgttcatcttccctcccagcgacgagcagctgaagtctggcaccgccagcgtggtgtgcctgctgaacaacttctacccccgcgaggccaaggtgcagtggaaggtggacaacgccctgcagagcggcaacagccaggagagcgtgaccgagcaggactccaaggacagcacctacagcctgagcagcaccctgaccctgagcaaggccgactacgagaagcacaaggtgtacgcctgcgaggtgacccaccagggactgtctagccccgtgaccaagagcttcaaccggggcgagtgctaa

SEQ ID NO: 755 - DNA, 660 bp, Artificial Sequence
  15F10.2D6 light chain DNA sequence
gatgttttgatgacccaaactccactctccctgcctgtcagtcttggagatcaagcctccatctcttgcagatctagtcagagcattgtacataataatggaaacacctatttagaatggtacctgcagaaaccaggccagtctccaaaactcctgatctacaaagtttccaaccgattttctggggtcccagacaggttcagtggcagtggatcagggacagatttcacactcaagatcagcagagtggaggctgaggatctgggagtttattactgctttcaaggttcacatgttccgctcacgttcggtggtgggaccaagttggagctgaaacggaccgtggccgcccccagcgtgttcatcttccctcccagcgacgagcagctgaagtctggcaccgccagcgtggtgtgcctgctgaacaacttctacccccgcgaggccaaggtgcagtggaaggtggacaacgccctgcagagcggcaacagccaggagagcgtgaccgagcaggactccaaggacagcacctacagcctgagcagcaccctgaccctgagcaaggccgactacgagaagcacaaggtgtacgcctgcgaggtgacccaccagggactgtctagccccgtgaccaagagcttcaaccggggcgagtgctaa

SEQ ID NO: 756 - DNA, 645 bp, Artificial Sequence
  19B5.2E6 light chain DNA sequence
gatatacaaatgactcaaactacctcttctctttccgcatctttgggtgatcgggtcactatatcctgctccgcctctcaaggcataaacaattacctgaattggtatcagcaaaaaccagacggaactgtaaaattgcttatctactacgcttcaagtctgcatagtggggttcccagcagattttccggttccgggtccggcactgattattctctcacaattagtaacctggaacctgaggacattgcaacttattactgtcaacaatacagtcaggtaccttacactttcggatcaggaacaaagttggaaatcaagaggaccgtggccgcccccagcgtgttcatcttccctcccagcgacgagcagctgaagtctggcaccgccagcgtggtgtgcctgctgaacaacttctacccccgcgaggccaaggtgcagtggaaggtggacaacgccctgcagagcggcaacagccaggagagcgtgaccgagcaggactccaaggacagcacctacagcctgagcagcaccctgaccctgagcaaggccgactacgagaagcacaaggtgtacgcctgcgaggtgacccaccagggactgtctagccccgtgaccaagagcttcaaccggggcgagtgctaa

SEQ ID NO: 757 - DNA, 645 bp, Artificial Sequence
  20D11.2C6 light chain DNA sequence
gacatccagatgaaccagtctccatccagtctgtctgcatccctcggagacacaattaccatcacttgccgtgccagtcagaacatttatatttggttaagttggtaccagcagaaaccaggaaatattcctaaactcttgatctataaggcttccaacttgcacacaggcgtcccatcaaggtttagtggcagtggatctggaacagatttcacattaaccatcagcactctgcagcctgaagacattgccacttacttctgtctccagggtcaaagttatcctctcacgttcggtgctgggaccaagctggagatgaaacggaccgtggccgcccccagcgtgttcatcttccctcccagcgacgagcagctgaagtctggcaccgccagcgtggtgtgcctgctgaacaacttctacccccgcgaggccaaggtgcagtggaaggtggacaacgccctgcagagcggcaacagccaggagagcgtgaccgagcaggactccaaggacagcacctacagcctgagcagcaccctgaccctgagcaaggccgactacgagaagcacaaggtgtacgcctgcgaggtgacccaccagggactgtctagccccgtgaccaagagcttcaaccggggcgagtgctaa

SEQ ID NO: 758 - DNA, 645 bp, Artificial Sequence
  20H5.A3 light chain DNA sequence
gatatccagatgacacagactacatcctccctgtctgcctctctgggagacagagtcaccatcaattgcagtgcaagtcaggacattagcaattatttaaactggtatcagcagaaaccagatggaactgttaaactcctgatctattacacatcaagtttactctcaggagtcccatcaaggttcagtggcagtgggtctgggacagattattctctcaccatcagcaacctggaacctgaagatattgccacttacttttgtcagcaatatagtaagcttccctatacgttcggatcggggacccacctggaaataaaacggaccgtggccgcccccagcgtgttcatcttccctcccagcgacgagcagctgaagtctggcaccgccagcgtggtgtgcctgctgaacaacttctacccccgcgaggccaaggtgcagtggaaggtggacaacgccctgcagagcggcaacagccaggagagcgtgaccgagcaggactccaaggacagcacctacagcctgagcagcaccctgaccctgagcaaggccgactacgagaagcacaaggtgtacgcctgcgaggtgacccaccagggactgtctagccccgtgaccaagagcttcaaccggggcgagtgctaa

SEQ ID NO: 759 - DNA, 645 bp, Artificial Sequence
  23H9.2E4 light chain DNA sequence
gatatccagatgacacagactacatcctccctgtctgcctctctgggagacagagtcaccatcagttgcagtgcaagtcagggcattaacaattatttaaactggtatcagcagaaaccagatggaactgttaaactcctgatctattacgcatcaagtttacactcaggagtcccatcaaggttcagtggcagtgggtctgggacagattattctctcaccatcagcaacctggaacctgaagatattgccacttactattgtcagcagtatagtcaggttccgtatacgttcggatcggggaccaagttggaaataaaacggaccgtggccgcccccagcgtgttcatcttccctcccagcgacgagcagctgaagtctggcaccgccagcgtggtgtgcctgctgaacaacttctacccccgcgaggccaaggtgcagtggaaggtggacaacgccctgcagagcggcaacagccaggagagcgtgaccgagcaggactccaaggacagcacctacagcctgagcagcaccctgaccctgagcaaggccgactacgagaagcacaaggtgtacgcctgcgaggtgacccaccagggactgtctagccccgtgaccaagagcttcaaccggggcgagtgctaa

SEQ ID NO: 760 - DNA, 660 bp, Artificial Sequence
  2D10-VH0-VL0 light chain DNA sequence
gacatagtaatgacacaggccgcatttagcaatccagtaaccttgggcacatccgcctccatatcttgcaggtcatccaaaagcttgctgcactctgacggtattacttacctgtactggtatttgcagcgacctgggcaatcccctcaactcctgatttaccgcatgagcaacctggcctcaggggtgcctgaccgcttttcaggatcagggagcggcactgacttcaccttgcgaatcagcagagtagaagcagaggatgttggagtttactactgtgcccagatgatcgaatttccacttacttttggggccgggaccattctggagcttaaacggaccgtggccgcccccagcgtgttcatcttccctcccagcgacgagcagctgaagtctggcaccgccagcgtggtgtgcctgctgaacaacttctacccccgcgaggccaaggtgcagtggaaggtggacaacgccctgcagagcggcaacagccaggagagcgtgaccgagcaggactccaaggacagcacctacagcctgagcagcaccctgaccctgagcaaggccgactacgagaagcacaaggtgtacgcctgcgaggtgacccaccagggactgtctagccccgtgaccaagagcttcaaccggggcgagtgctaa

SEQ ID NO: 761 - DNA, 660 bp, Artificial Sequence
  3B11.2G2 light chain DNA sequence
gatgttgtgatgacccagactccactcactttgtcggttgccattggacaaccagcttccatctcttgcaagtcgagtcagagcctcttatatactaatggaaaaacctatttgaattggttattacagaggccaggccagtctccaaaacgcctaatctatctggtgtctaaattggactctggagtccctgacaggttcagtggcagtggatcagggacagatttcacactgaaaatcagcagagtggaggctgaggatttgggagtttattactgcttgcagagtacacattttccgctcacgttcggtgctgggaccaagctggagctgaaacggaccgtggccgcccccagcgtgttcatcttccctcccagcgacgagcagctgaagtctggcaccgccagcgtggtgtgcctgctgaacaacttctacccccgcgaggccaaggtgcagtggaaggtggacaacgccctgcagagcggcaacagccaggagagcgtgaccgagcaggactccaaggacagcacctacagcctgagcagcaccctgaccctgagcaaggccgactacgagaagcacaaggtgtacgcctgcgaggtgacccaccagggactgtctagccccgtgaccaagagcttcaaccggggcgagtgctaa

SEQ ID NO: 762 - DNA, 660 bp, Artificial Sequence
  7D8.2D8 light chain DNA sequence
gatgttttgatgacccaaactccactctccctgcctgtcagtcttggagatcaagcctccatctcttgcagatctagtcagagcattgtacatagtaatggaaacacctatttagaatggtacctgcagaaaccaggccagtctccaaagctcctgatctacaaagtttccaaccgattttctggggtcccagacaggttcagtggcagtggatcagggacagatttcacactcaagatcagcagagtggaggctgaggatctgggagtttattactgctttcaaggttcacatgttccgctcacgttcggtgctgggaccaagctggagctgaaacggaccgtggccgcccccagcgtgttcatcttccctcccagcgacgagcagctgaagtctggcaccgccagcgtggtgtgcctgctgaacaacttctacccccgcgaggccaaggtgcagtggaaggtggacaacgccctgcagagcggcaacagccaggagagcgtgaccgagcaggactccaaggacagcacctacagcctgagcagcaccctgaccctgagcaaggccgactacgagaagcacaaggtgtacgcctgcgaggtgacccaccagggactgtctagccccgtgaccaagagcttcaaccggggcgagtgctaa

SEQ ID NO: 763 - DNA, 663 bp, Artificial Sequence
  mIMT001 light chain DNA sequence
gatattgttattactcaggatgagcttagtaatcctgtcactagcggggaaagtgttagtatcagttgtcgttcatccaagtcactcctctacaaagacggcaagacttatctcaactggtttcttcaacgacccggtcaatctccacagctcctgatttacctgatgtcaactcacgcttctggtgttagcgaccgtttctccggaagtggctccgggacagacttcactcttgaaatctcacgtgtaaaagcagaggacgtaggtgtctattattgtcaacagcttgtggactaccccttgacctttggcgctggcacaaagctggaactgaagcgtgctgatgttgcccctactgtgtccatcttccccccctcctccgagcagctgacatccggcggcgcctccgtggtgtgcttcctgaacaacttctaccccaaagacatcaacgtgaaatggaaaatcgacggctccgagaggcagaacggcgtgctgaactcctggacagaccaggactccaaagactccacatactccatgtcctccacactgacactgacaaaagacgagtacgagaggcacaactcctacacatgcgaggccacacacaaaacatccacatcccccatcgtgaaatccttcaacaggaacgagtgctaataa

SEQ ID NO: 764 - DNA, 660 bp, Artificial Sequence
  4A11.2B5 light chain DNA sequence
gacattgtgatgactcaggcagccttttccaaccctgtaacacttggaactagtgcctccatctcatgccgttccagcaagagtcttttgcacagcgatgggataacctatctctattggtatctgcaacgacccggtcagtcaccccaacttcttatctatcgaatgtctaacttggcctccggcgtgcccgaccgcttttccgggagtgggagcggtacagatttcaccttgcgaatttcccgggttgaggcagaggacgtaggtgtctactattgtgctcagatgcttgagtttcctctcactttcggagccggcaccaaactggaactgaaacggaccgtggccgcccccagcgtgttcatcttccctcccagcgacgagcagctgaagtctggcaccgccagcgtggtgtgcctgctgaacaacttctacccccgcgaggccaaggtgcagtggaaggtggacaacgccctgcagagcggcaacagccaggagagcgtgaccgagcaggactccaaggacagcacctacagcctgagcagcaccctgaccctgagcaaggccgactacgagaagcacaaggtgtacgcctgcgaggtgacccaccagggactgtctagccccgtgaccaagagcttcaaccggggcgagtgctaa

SEQ ID NO: 765 - DNA, 660 bp, Artificial Sequence; identical to SEQ ID NO: 751
  4A11.H1L1 light chain DNA sequence

SEQ ID NO: 766 - DNA, 660 bp, Artificial Sequence
  4A11.H4L2 light chain DNA sequence
gatattgtaatgacccaaagccccctgtccttgcctgttaccccaggtgagcctgccagcatatcttgccgatccagtaaatctctgcttcatagcgatggcatcacctatttgtattggtatttgcagaagcccggccagagcccccagttgctgatctacagaatgtccaaccttgctagtggagtgcccgaccggtttagcggttcaggctcagggactgatttcactcttaaaatcagtagggtagaggccgaagacgttggtgtatattattgtgctcagatgttggagtttccactcacatttggacaaggtacaaagctggaaattaagcggaccgtggccgcccccagcgtgttcatcttccctcccagcgacgagcagctgaagtctggcaccgccagcgtggtgtgcctgctgaacaacttctacccccgcgaggccaaggtgcagtggaaggtggacaacgccctgcagagcggcaacagccaggagagcgtgaccgagcaggactccaaggacagcacctacagcctgagcagcaccctgaccctgagcaaggccgactacgagaagcacaaggtgtacgcctgcgaggtgacccaccagggactgtctagccccgtgaccaagagcttcaaccggggcgagtgctaa

SEQ ID NO: 767 - DNA, 660 bp, Artificial Sequence
  4G2.2G6 light chain DNA sequence
gatgtcgtaatgactcaaacccccctgacccttagtgttactataggccagcccgcaagcatctcctgcaaatcctcccagtctcttctttatactgatggcaaaacctacttgtcctggtttttgcagcgcccaggtcaaagtcctaaacgtcttatttacttggtctctaaactcgattccggcgtgcctgaccggttctccggtagcggtagcggtaccgatttcactttgaagattagccgagttgaggcagaagacctcggggtctactactgccttcagagtacacacttcccacttacatttggcgcaggaaccaagttggaggttaaacggaccgtggccgcccccagcgtgttcatcttccctcccagcgacgagcagctgaagtctggcaccgccagcgtggtgtgcctgctgaacaacttctacccccgcgaggccaaggtgcagtggaaggtggacaacgccctgcagagcggcaacagccaggagagcgtgaccgagcaggactccaaggacagcacctacagcctgagcagcaccctgaccctgagcaaggccgactacgagaagcacaaggtgtacgcctgcgaggtgacccaccagggactgtctagccccgtgaccaagagcttcaaccggggcgagtgctaa

SEQ ID NO: 768 - DNA, 645 bp, Artificial Sequence
  6B3.2D3 light chain DNA sequence
agtattgtgatgacccagactcccaaattcctgcttgtatcagcaggagacagggttaccataacctgcaaggccagtcagagtgtgagtaatgatgtagcttggtaccaacagaagccagggcagtctcctaaattgttgatatattatgcatccaatcgctacactggagtccctgatcgcttcactggcagtggatatgggacggatttcactttcaccatcagcactgtgcaggctgaagacctggcagtttatttctgtcagcaggattatacctctccgtacacgttcggaggggggaccaagctggaaataaaacggaccgtggccgcccccagcgtgttcatcttccctcccagcgacgagcagctgaagtctggcaccgccagcgtggtgtgcctgctgaacaacttctacccccgcgaggccaaggtgcagtggaaggtggacaacgccctgcagagcggcaacagccaggagagcgtgaccgagcaggactccaaggacagcacctacagcctgagcagcaccctgaccctgagcaaggccgactacgagaagcacaaggtgtacgcctgcgaggtgacccaccagggactgtctagccccgtgaccaagagcttcaaccggggcgagtgctaa

SEQ ID NO: 769 - DNA, 645 bp, Artificial Sequence
  6H6.2D6 light chain DNA sequence
gacatccagatgacccagaccacctcctccctgtccgcctccctgggcgacagggtgaccatctcctgctccgcctcccagggcatctccaactacctgaactggtaccagcagaagcccgacggcaccgtgaagctgctgatctactacacctcctccctgcactccggcgtgccctccaggttctccggctccggctccggcaccgactactccctgaccatctccaacctggagcccgaggacatcgccacctactactgccagcagtactccgagctgccctacaccttcggctccggcaccaagctggagatcaagaggaccgtggccgcccccagcgtgttcatcttccctcccagcgacgagcagctgaagtctggcaccgccagcgtggtgtgcctgctgaacaacttctacccccgcgaggccaaggtgcagtggaaggtggacaacgccctgcagagcggcaacagccaggagagcgtgaccgagcaggactccaaggacagcacctacagcctgagcagcaccctgaccctgagcaaggccgactacgagaagcacaaggtgtacgcctgcgaggtgacccaccagggactgtctagccccgtgaccaagagcttcaaccggggcgagtgctaa

SEQ ID NO: 770 - DNA, 645 bp, Artificial Sequence
  9H2.2H10 light chain DNA sequence
gacattgtgatgacccagtctcacaaattcatgtccacatcagtaggagacagggtcagcatcacctgcaaggccagtcaggatgtgagtactgctgtagcctggtatcaacaaaaaccagggcaatctcctaaactactgatttactgggcatccacccggcacactggagtccctgatcgcttcacaggcagtggatctgggacagattatactctcaccatcagcagtgtgcaggctgaagacctggcactttattactgtcagcaacattataccactccgctcacgttcggtgctgggaccaagctggagctgaaacggaccgtggccgcccccagcgtgttcatcttccctcccagcgacgagcagctgaagtctggcaccgccagcgtggtgtgcctgctgaacaacttctacccccgcgaggccaaggtgcagtggaaggtggacaacgccctgcagagcggcaacagccaggagagcgtgaccgagcaggactccaaggacagcacctacagcctgagcagcaccctgaccctgagcaaggccgactacgagaagcacaaggtgtacgcctgcgaggtgacccaccagggactgtctagccccgtgaccaagagcttcaaccggggcgagtgctaa

SEQ ID NO: 771 - DNA, 645 bp, Artificial Sequence
  13G4.2F8 light chain DNA sequence
gacattgtgatgacccagtctcaaaaattcatgtccacatcagtaggagagagggtcagcatcacctgcaaggccagtcagaatgtaggtactaatgtagcctggtatcagcagaaagcagggcagtctcttgaactgctgatctatggggcatccaaccggcacactggagtccctgatcgcttcacaggcagtggatctgggacagatttcactctcaccatcaccaatgtgcagtctgaagacatgacaaattatttctgtgagcaatatagcaactttcctctcacgttcggtgctgggaccaagctggagctgaaacggaccgtggccgcccccagcgtgttcatcttccctcccagcgacgagcagctgaagtctggcaccgccagcgtggtgtgcctgctgaacaacttctacccccgcgaggccaaggtgcagtggaaggtggacaacgccctgcagagcggcaacagccaggagagcgtgaccgagcaggactccaaggacagcacctacagcctgagcagcaccctgaccctgagcaaggccgactacgagaagcacaaggtgtacgcctgcgaggtgacccaccagggactgtctagccccgtgaccaagagcttcaaccggggcgagtgctaa

SEQ ID NO: 772 - DNA, 660 bp, Artificial Sequence
  13H12.2F8 light chain DNA sequence
gacgttgttatgacacaaacaccacttacactttctgtaactatcggtcagcctgcctcaatttcatgtaagtcttctcagtccctgtttcatagcgacgggaagacttacctgaattggcttctccaacgaccaggccaatcacccaagcgccttatttatttggtcagtaaattggacagtggagttcccgatagatttaccgggagcggttctgggaccgatttcaccccaaagatctccagggtagaagacgaagatctcggtgtgtactattgctggcaggggacacatttccctctgacattcggtgctggaaccaaacttgagatgaaacggaccgtggccgcccccagcgtgttcatcttccctcccagcgacgagcagctgaagtctggcaccgccagcgtggtgtgcctgctgaacaacttctacccccgcgaggccaaggtgcagtggaaggtggacaacgccctgcagagcggcaacagccaggagagcgtgaccgagcaggactccaaggacagcacctacagcctgagcagcaccctgaccctgagcaaggccgactacgagaagcacaaggtgtacgcctgcgaggtgacccaccagggactgtctagccccgtgaccaagagcttcaaccggggcgagtgctaa

SEQ ID NO: 773 - DNA, 645 bp, Artificial Sequence
  15G7.2A7 light chain DNA sequence
gacatccagatgaaccagtctccatccagtctgtctgcatccctcggagacacaatttccatcacttgccgtgccagtcagaacattaatatttggttaagctggtaccagcagaaaccaggaaatattcctcaactattgatctataaggcttccaacttgcacacaggcgtcccctcaaggtttagtggcagtggatctggaacagatttcacattaaccatcagcagtctgcagcctgaagacattgccacttactactgtctacagggtcaaagttatcctctcacgttcggtgctgggaccaagctggtgatgaaacggaccgtggccgcccccagcgtgttcatcttccctcccagcgacgagcagctgaagtctggcaccgccagcgtggtgtgcctgctgaacaacttctacccccgcgaggccaaggtgcagtggaaggtggacaacgccctgcagagcggcaacagccaggagagcgtgaccgagcaggactccaaggacagcacctacagcctgagcagcaccctgaccctgagcaaggccgactacgagaagcacaaggtgtacgcctgcgaggtgacccaccagggactgtctagccccgtgaccaagagcttcaaccggggcgagtgctaa

SEQ ID NO: 774 - DNA, 654 bp, Artificial Sequence
  19D9.2E5 light chain DNA sequence
gatgttgtgatgacccagactccactcactttgtcggttaccattggacaaccagcctccatctcttgtaagtcaagtcagagcctcttacatagtgatggaaagacatatttgaattggttgttacagaggccaggccagcctccaaagcgcctaatgtatctggtgtctacactggactctggagtccctgacaggttcactggcagtggatcagggacagatttcacactgaaaatcagcagagtggaggctgaggatttgggagtttattattgctggcaaggtacacattttcctctcacgttcggtgctgggaccaagccggagcggaccgtggccgcccccagcgtgttcatcttccctcccagcgacgagcagctgaagtctggcaccgccagcgtggtgtgcctgctgaacaacttctacccccgcgaggccaaggtgcagtggaaggtggacaacgccctgcagagcggcaacagccaggagagcgtgaccgagcaggactccaaggacagcacctacagcctgagcagcaccctgaccctgagcaaggccgactacgagaagcacaaggtgtacgcctgcgaggtgacccaccagggactgtctagccccgtgaccaagagcttcaaccggggcgagtgctaa

SEQ ID NO: 775 - DNA, 654 bp, Artificial Sequence
  23B10.2B12 light chain DNA sequence
gatattgtgatgacgcaggctgcattctccaatccagtcactcttggaacgtcagcttccatctcctgcaggtctagtaagagtctcctacatagtgatggcatcacttatttctattggtatctgcagaggccaggccagtctcctcagctcctgatatatcggatgtccaaccttgcctcaggagtcccagacaggttcagtggcagtgggtcaggaactgatttcacactgagaatcagcagagtggaggctgaggatgtgggtgtttattactgtgctcaaatgctagaattcccgctcacgttcggtgctgggaccaagctggagcggaccgtggccgcccccagcgtgttcatcttccctcccagcgacgagcagctgaagtctggcaccgccagcgtggtgtgcctgctgaacaacttctacccccgcgaggccaaggtgcagtggaaggtggacaacgccctgcagagcggcaacagccaggagagcgtgaccgagcaggactccaaggacagcacctacagcctgagcagcaccctgaccctgagcaaggccgactacgagaagcacaaggtgtacgcctgcgaggtgacccaccagggactgtctagccccgtgaccaagagcttcaaccggggcgagtgctaa

SEQ ID NO: 776 - DNA, 645 bp, Artificial Sequence
  24D12.2H9 light chain DNA sequence
gacattgtgatgacccagtctcacaaattcatgtccacatcagtaggagacagggtcagcatcacctgcaaggccagtcaggatgtgcgtactgctgtagcctggtatcaacagaaaccagggcaatctcctaaactactgatttactgggcatccacccggcacactggagtccctgatcgcttcacaggcagtggatctgggacagatttcactctcacccttagcaatgtgcagtctgaagacttggcagattatttctgtcagcaatatagtagttatccgtggacgttcggtggaggcaccaagctggaaatcaaacggaccgtggccgcccccagcgtgttcatcttccctcccagcgacgagcagctgaagtctggcaccgccagcgtggtgtgcctgctgaacaacttctacccccgcgaggccaaggtgcagtggaaggtggacaacgccctgcagagcggcaacagccaggagagcgtgaccgagcaggactccaaggacagcacctacagcctgagcagcaccctgaccctgagcaaggccgactacgagaagcacaaggtgtacgcctgcgaggtgacccaccagggactgtctagccccgtgaccaagagcttcaaccggggcgagtgctaa

SEQ ID NO: 777 - DNA, 660 bp, Artificial Sequence
  F846C.1B2 light chain DNA sequence
aacatttggttgacacagtcgccatcatctctggctgtgtctgcaggagaaatggtcactatgacctgtaagtccagtcaaagtgttttatacagttcaaatcagaagaactacttggcctggtaccagcagaaaccagggcagtctcctaaactgctgatctactgggcatccactagggaatctggtgtccctgatcgcttcacaggcagtggatctgggacagacttttctcttaccatcagcagtgtacaagctgaagacctggcagtttattactgtcatcaatatctctcctcgctcacgttcggtgctgggaccaagctggagctgaaacggaccgtggccgcccccagcgtgttcatcttccctcccagcgacgagcagctgaagtctggcaccgccagcgtggtgtgcctgctgaacaacttctacccccgcgaggccaaggtgcagtggaaggtggacaacgccctgcagagcggcaacagccaggagagcgtgaccgagcaggactccaaggacagcacctacagcctgagcagcaccctgaccctgagcaaggccgactacgagaagcacaaggtgtacgcctgcgaggtgacccaccagggactgtctagccccgtgaccaagagcttcaaccggggcgagtgctaa

SEQ ID NO: 778 - DNA, 660 bp, Artificial Sequence
  F846C.1F5 light chain DNA sequence
aacattatgatgacacagtcgccatcatctctggctgtgtctgcaggagaaaaggtcactatgagctgtaagtccagtcaaagtgttttatacagttcaaatcagaagaactacttggcctggtaccagcagaaaccagggcagtctcctaaactgctgatctactgggcatccactagggaatctggtgtccctgatcgcttcacaggcagtggatctgggacagattttactcttaccatcagcagtgtacaacctgaagacctggcagtttattactgtcatcaatacctctcctcgctcacgttcggtgctgggaccaagctggagctgaaacggaccgtggccgcccccagcgtgttcatcttccctcccagcgacgagcagctgaagtctggcaccgccagcgtggtgtgcctgctgaacaacttctacccccgcgaggccaaggtgcagtggaaggtggacaacgccctgcagagcggcaacagccaggagagcgtgaccgagcaggactccaaggacagcacctacagcctgagcagcaccctgaccctgagcaaggccgactacgagaagcacaaggtgtacgcctgcgaggtgacccaccagggactgtctagccccgtgaccaagagcttcaaccggggcgagtgctaa

SEQ ID NO: 779 - DNA, 660 bp, Artificial Sequence
  F846C.1H12 light chain DNA sequence
aacattatgatgacacagtcgccatcatctctggctgtgtctgcaggacaaaaggtcactatgagctgtaagtccagtcaaagtgttttatacagttcaagtcagaagaactacttggcctggtaccagcagaaaccagggcagtctcctaaacttctgatctactgggcatccactagggaatctggtgtccctgatcgcttctcaggcagtggatctgggacagattttactcttaccatcagcagtgtacaacctgaagacctggcagtttattactgtcatcaatacctctcctcgctcacgttcggtgctgggaccaagctggagctgaaacggaccgtggccgcccccagcgtgttcatcttccctcccagcgacgagcagctgaagtctggcaccgccagcgtggtgtgcctgctgaacaacttctacccccgcgaggccaaggtgcagtggaaggtggacaacgccctgcagagcggcaacagccaggagagcgtgaccgagcaggactccaaggacagcacctacagcctgagcagcaccctgaccctgagcaaggccgactacgagaagcacaaggtgtacgcctgcgaggtgacccaccagggactgtctagccccgtgaccaagagcttcaaccggggcgagtgctaa

SEQ ID NO: 780 - DNA, 663 bp, Artificial Sequence
  F846C.1H5 light chain DNA sequence
gatgttgtgatgacccaaactccactctccctgcctgtcagtcttggagatcaagcctccatctcttgcagatctagtcagagccttgtacacaatagtggaaacacctatttacattggtacctgcagaggccaggccagtctccaaacctcctgatctacaaagtttccaaccgattttctggggtcccagacaggttcagtggcagtggatcagggacagatttcacactcaagatcagcagagtggcggctgaggatctgggagtttatttctgctctcaaagtacacatgttcctccgacgttcggtggaggcaccaagctggaaatcaaacggaccgtggccgcccccagcgtgttcatcttccctcccagcgacgagcagctgaagtctggcaccgccagcgtggtgtgcctgctgaacaacttctacccccgcgaggccaaggtgcagtggaaggtggacaacgccctgcagagcggcaacagccaggagagcgtgaccgagcaggactccaaggacagcacctacagcctgagcagcaccctgaccctgagcaaggccgactacgagaagcacaaggtgtacgcctgcgaggtgacccaccagggactgtctagccccgtgaccaagagcttcaaccggggcgagtgctaagga

SEQ ID NO: 781 - DNA, 660 bp, Artificial Sequence; identical to SEQ ID NO: 778
  F846C.2H3 light chain DNA sequence

SEQ ID NO: 782 - DNA, 651 bp, Artificial Sequence
  F846TC.14A2 light chain DNA sequence
caggctgttgtgactcaggaatctgcactcaccacatcacctggtgaaacagtcacactcacttgtcgctcaagtactggggctgttacaactagtaactatgccaactgggtccaagaaaaaccagatcatttattcactggtctaataggtggtatcaataaccgagttccaggtgttcctgccagattctcaggctccctgattggagacaaggcagccctcaccatcacaggggcacagactgaggatgaggcaatatatttctgtgctctatggtatagcaaccattgggtgttcggtggaggaaccaaactgactgtcctacggaccgtggccgcccccagcgtgttcatcttccctcccagcgacgagcagctgaagtctggcaccgccagcgtggtgtgcctgctgaacaacttctacccccgcgaggccaaggtgcagtggaaggtggacaacgccctgcagagcggcaacagccaggagagcgtgaccgagcaggactccaaggacagcacctacagcctgagcagcaccctgaccctgagcaaggccgactacgagaagcacaaggtgtacgcctgcgaggtgacccaccagggactgtctagccccgtgaccaagagcttcaaccggggcgagtgctaa

SEQ ID NO: 783 - DNA, 660 bp, Artificial Sequence
  F846TC.14E4 light chain DNA sequence
gatattgtgatgacgcaggctgcattctccaatccagtcactcttggaacatcagcttccatctcctgcaggtctagtaagagtctcctacatactaatggcatcacttttttgtattggtatctgcagaagccaggccagtctcctcagcccctgatttatcagatgtccaaccttgcctcaggagtcccagacaggttcagtagcagtgggtcaggaactgatttcacactgagaatcagcagagtggaggctgaggatgtgggtgtttattactgtgctcaaaatctagaacttccttggacgttcggtggaggcaccaagctggaaatcaatcggaccgtggccgcccccagcgtgttcatcttccctcccagcgacgagcagctgaagtctggcaccgccagcgtggtgtgcctgctgaacaacttctacccccgcgaggccaaggtgcagtggaaggtggacaacgccctgcagagcggcaacagccaggagagcgtgaccgagcaggactccaaggacagcacctacagcctgagcagcaccctgaccctgagcaaggccgactacgagaagcacaaggtgtacgcctgcgaggtgacccaccagggactgtctagccccgtgaccaagagcttcaaccggggcgagtgctaa

SEQ ID NO: 784 - DNA, 660 bp, Artificial Sequence
  F846TC.16B5 light chain DNA sequence
aacattatgatgacacagtcgccatcatctctggctgtgtctgcaggagaaaaggtcactatgagctgtaagtccagtcaaagtgttttatacagttcaaatcagaagaactacttggcctggtaccagcagaaaccagggcagtctcctaaactactgatctactgggcatccactagggaatctggtgtccctgatcgcttcacaggcagtggatctgggacagattttactcttaccatcagcagtgtacaagctgaagacctggcagtttattactgtcatcaatacctctcctcgctcacgttcggtgctgggaccaagctggagctgaaacggaccgtggccgcccccagcgtgttcatcttccctcccagcgacgagcagctgaagtctggcaccgccagcgtggtgtgcctgctgaacaacttctacccccgcgaggccaaggtgcagtggaaggtggacaacgccctgcagagcggcaacagccaggagagcgtgaccgagcaggactccaaggacagcacctacagcctgagcagcaccctgaccctgagcaaggccgactacgagaagcacaaggtgtacgcctgcgaggtgacccaccagggactgtctagccccgtgaccaagagcttcaaccggggcgagtgctaa

SEQ ID NO: 785 - DNA, 663 bp, Artificial Sequence
  F846TC.7F10 light chain DNA sequence
gacattgtgatgacacagtctccatcctccctggctatgtcagtaggacagaaggtcactatgagctgcaagtccagtcagagccttttaaatagtagcaatcaaaagaactatttggcctggtaccagcagaaaccaggacagtctcctaaacttctggtatactttgcatccactagggaatctggggtccctgatcgcttcataggcagtggatctgggacagatttcactcttaccatcagcagtgtgcaggctgaagacctggcagattacttctgtcagcaacattatagcactccgtacacgttcggagggggggccaagctggaaataaaacggaccgtggccgcccccagcgtgttcatcttccctcccagcgacgagcagctgaagtctggcaccgccagcgtggtgtgcctgctgaacaacttctacccccgcgaggccaaggtgcagtggaaggtggacaacgccctgcagagcggcaacagccaggagagcgtgaccgagcaggactccaaggacagcacctacagcctgagcagcaccctgaccctgagcaaggccgactacgagaagcacaaggtgtacgcctgcgaggtgacccaccagggactgtctagccccgtgaccaagagcttcaaccggggcgagtgctaa

SEQ ID NO: 786 - DNA, 645 bp, Artificial Sequence
  F847C.10B9 light chain DNA sequence
gacatccggatgactcagtctccatccagtctgtctgcatcccttggagacacaattaccatcacttgccatgccagtcagaacattaatgtttggttaagctggtaccagcagaaaccaggaaatattcctaaactattgatctataaggcttccaacttgcacacaggcgtcccatcaaggtttagtggcagtggatctggaacaggtttcacattaaccatcagcagcctgcagcctgaagacattgccacttactactgtcaacagggtcaaagttatccgtacacgttcggaggggggaccaagctggagctgaaacggaccgtggccgcccccagcgtgttcatcttccctcccagcgacgagcagctgaagtctggcaccgccagcgtggtgtgcctgctgaacaacttctacccccgcgaggccaaggtgcagtggaaggtggacaacgccctgcagagcggcaacagccaggagagcgtgaccgagcaggactccaaggacagcacctacagcctgagcagcaccctgaccctgagcaaggccgactacgagaagcacaaggtgtacgcctgcgaggtgacccaccagggactgtctagccccgtgaccaagagcttcaaccggggcgagtgctaa

SEQ ID NO: 787 - DNA, 645 bp, Artificial Sequence
  F847C.11B1 light chain DNA sequence
gaaattgtgttgacccagtctccagcatccctgtccgtgactacaggagaaaaagtcactatcagatgcataaccagcattgatattgatgatgatatgaactggtaccagcagaagccaggggaacctcctaagctccttatttcagaaggcaatactcttcgtcctggagtcccatcccgattctccagcagtggctatggcacagattttgtttttacaattgaaaacacgctctcagaagatgttgcagattactactgtttgcaaagtgataacaagcctctcacgttcggtgctgggaccaagctggagctgaaacggaccgtggccgcccccagcgtgttcatcttccctcccagcgacgagcagctgaagtctggcaccgccagcgtggtgtgcctgctgaacaacttctacccccgcgaggccaaggtgcagtggaaggtggacaacgccctgcagagcggcaacagccaggagagcgtgaccgagcaggactccaaggacagcacctacagcctgagcagcaccctgaccctgagcaaggccgactacgagaagcacaaggtgtacgcctgcgaggtgacccaccagggactgtctagccccgtgaccaagagcttcaaccggggcgagtgctaa

SEQ ID NO: 788 - DNA, 645 bp, Artificial Sequence
  F847C.12F12 light chain DNA sequence
gacatccaggtgattcagtctccatccagtctgtctgcatcccttggagacacaattaccatcacttgccatgccagtcagaacattaatgtttggttaagctggtaccagcagaaaccaggaaatattcctaaactattgatctataaggcttccaacttgcacacaggcgtcccatcaaggtttagtggcagtggatctggaacaggtttcacattaaccatcagcagcctgcagcctgaagacattgccacttactactgtcaacagggtcaaagttatccgtacacgttcggaggggggaccaagctggagctgaaacggaccgtggccgcccccagcgtgttcatcttccctcccagcgacgagcagctgaagtctggcaccgccagcgtggtgtgcctgctgaacaacttctacccccgcgaggccaaggtgcagtggaaggtggacaacgccctgcagagcggcaacagccaggagagcgtgaccgagcaggactccaaggacagcacctacagcctgagcagcaccctgaccctgagcaaggccgactacgagaagcacaaggtgtacgcctgcgaggtgacccaccagggactgtctagccccgtgaccaagagcttcaaccggggcgagtgctaa

SEQ ID NO: 789 - DNA, 646 bp, Artificial Sequence
  F847C.26F5 light chain DNA sequence
gaaattaagatgaaccagtctccatccagtctgtctgcatcccttggagacacaattaccatcacttgccatgccagtcagaacattaatgtttggttaagctggtaccagcagaaaccaggaaatattcctaaactattgatctataaggcttccaacttgcacacaggcgtcccatcaaggtttagtggcagtggatctggaacaggtttcacattaaccatcagcagcctacagcctgaagacattgccacttactactgtcaacagggtcaaagttatccgtacacgttcggaggggggaccaagctggagctgaaaaggaccgtggccgcccccagcgtgttcatcttccctcccagcgacgagcagctgaagtctggcaccgccagcgtggtgtgcctgctgaacaacttctacccccgcgaggccaaggtgcagtggaaggtggacaacgccctgcagagcggcaacagccaggagagcgtgaccgagcaggactccaaggacagcacctacagcctgagcagcaccctgaccctgagcaaggccgactacgagaagcacaaggtgtacgcctgcgaggtgacccaccagggactgtctagccccgtgaccaagagcttcaaccggggcgagtgctaag

SEQ ID NO: 790 - DNA, 651 bp, Artificial Sequence
  F847C.4B10 light chain DNA sequence
caggctgttgtgactcaggaatctgcactcaccacatcacctggtgaaacagtcacactcacttgtcgctcaagtactggggctgttacaactagtaactatgccaactgggtccaagaaaaaccagatcatttattcactggtctaataggtggtaccaacaaccgagctccaggtgttcctgccagattctcaggctccctgattggagacaaggctgccctcaccatcacaggggcacagactgaggatgaggcaatatatttctgtgctctatggtacagcaaccatttagtgttcggtggaggaaccaaactgactgtcctaaggaccgtggccgcccccagcgtgttcatcttccctcccagcgacgagcagctgaagtctggcaccgccagcgtggtgtgcctgctgaacaacttctacccccgcgaggccaaggtgcagtggaaggtggacaacgccctgcagagcggcaacagccaggagagcgtgaccgagcaggactccaaggacagcacctacagcctgagcagcaccctgaccctgagcaaggccgactacgagaagcacaaggtgtacgcctgcgaggtgacccaccagggactgtctagccccgtgaccaagagcttcaaccggggcgagtgctaa

SEQ ID NO: 791 - DNA, 660 bp, Artificial Sequence
  F849C.8D10 light chain DNA sequence
gatgttttgatgacccaaactccactctccctgcctgtcagtcttggagatcaagcctccatctcttgcagatctagtcaggacattgtgcatagtagtggaaacacctatttagaatggtacctgcagaaaccaggccagtctctaaagctcctgatttacaaagtttccaaccgattttctggggtcccagacaggttcagtgccagtggatcagggacagatttcacactcaagatcagcagagtggaggctgaggatctgggagtttattactgctttcaaggttcacatgttcctcccacgttcggctcggggacaaagttggaaataaaacggaccgtggccgcccccagcgtgttcatcttccctcccagcgacgagcagctgaagtctggcaccgccagcgtggtgtgcctgctgaacaacttctacccccgcgaggccaaggtgcagtggaaggtggacaacgccctgcagagcggcaacagccaggagagcgtgaccgagcaggactccaaggacagcacctacagcctgagcagcaccctgaccctgagcaaggccgactacgagaagcacaaggtgtacgcctgcgaggtgacccaccagggactgtctagccccgtgaccaagagcttcaaccggggcgagtgctaa

SEQ ID NO: 792 - DNA, 660 bp, Artificial Sequence
  F849C.8H3 light chain DNA sequence
gatattgggatgaggcaggctgcattctccaatccagtcactcttggaacatcagcttccatctcctgcaggtctagtaagagtctcctatatagtaatggcatcacttatttgtattggtttctccagaagccaggccagtctcctcagctcctgatttatcagatgtccaaccttgcctcaggagtcccagacaggttcagtagcagtgggtcaggaactgatttcacactgagaatcagcagagtggaggctgacgatgtgggtgtttattactgtgctcaaaatctagaacttccgtggacgttcggtggaggcaccaagctggaaatcaaacggaccgtggccgcccccagcgtgttcatcttccctcccagcgacgagcagctgaagtctggcaccgccagcgtggtgtgcctgctgaacaacttctacccccgcgaggccaaggtgcagtggaaggtggacaacgccctgcagagcggcaacagccaggagagcgtgaccgagcaggactccaaggacagcacctacagcctgagcagcaccctgaccctgagcaaggccgactacgagaagcacaaggtgtacgcctgcgaggtgacccaccagggactgtctagccccgtgaccaagagcttcaaccggggcgagtgctaa

SEQ ID NO: 793 - DNA, 657 bp, Artificial Sequence
  846.2B11 light chain DNA sequence
gacattgtgctgacacagtctcctgcttccttaggtgtttctctggggcagagggccaccatctcatgcagggccagcaaaagtgtcagtacatctggctatagttatatgcactggtaccaacagaaaccaggacagccacccaaactcctcatctatcttgcatccatcctagaatctggggtccctgccaggttcagtggcagtgggtctgggacagacttcaccctcaacatccatcctgtggaggaggaggatgctgcaatctattactgtcagcacagtagggagcttcctctcacgttcggtgctgggaccaagctggagctgaaacggaccgtggccgcccccagcgtgttcatcttccctcccagcgacgagcagctgaagtctggcaccgccagcgtggtgtgcctgctgaacaacttctacccccgcgaggccaaggtgcagtggaaggtggacaacgccctgcagagcggcaacagccaggagagcgtgaccgagcaggactccaaggacagcacctacagcctgagcagcaccctgaccctgagcaaggccgactacgagaagcacaaggtgtacgcctgcgaggtgacccaccagggactgtctagccccgtgaccaagagcttcaaccggggcgagtgctaa

SEQ ID NO: 794 - DNA, 657 bp, Artificial Sequence
  846.4D5 light chain DNA sequence
aacattgtgctgacccaatctccagcttctttggctgtgtctctagggcagagggccaccatatcctgcagagccagtgaaagtgttgatagttatggcaatagttttatgcactggtaccagcagaaaccaggacagccacccaaactcctcatctatcttgcatccaacctagaatctggggtccctgccaggttcagtggcagtgggtctaggacagacttcaccctcaccattgatcctgtggaggctgatgatgctgcaacctattactgtcagcaaaataatgaggatccgtggacgttcggtggaggcaccaagctggaaatcaaacggaccgtggccgcccccagcgtgttcatcttccctcccagcgacgagcagctgaagtctggcaccgccagcgtggtgtgcctgctgaacaacttctacccccgcgaggccaaggtgcagtggaaggtggacaacgccctgcagagcggcaacagccaggagagcgtgaccgagcaggactccaaggacagcacctacagcctgagcagcaccctgaccctgagcaaggccgactacgagaagcacaaggtgtacgcctgcgaggtgacccaccagggactgtctagccccgtgaccaagagcttcaaccggggcgagtgctaa

SEQ ID NO: 795 - DNA, 660 bp, Artificial Sequence
  846T.1H2 light chain DNA sequence
gatgttgtgatgacccagactccactcactttgtcggttaccattggacaaccagcctctatctcttgcaagtcaagtcagagtctcttatatagtaatggaaaaacctatttgaattggttattacagaggccaggccagtctccaaagcgcctaatctatctggtgtctaaactggactctggagtccctgacaggttcactggcagtggatcaggaacagattttacactgaaaatcagcagagtggaggctgaggatttgggagtttattactgcgtgcaaggtacacattttcctcagacgttcggtggaggcaccaagctggaaataaaaaggaccgtggccgcccccagcgtgttcatcttccctcccagcgacgagcagctgaagtctggcaccgccagcgtggtgtgcctgctgaacaacttctacccccgcgaggccaaggtgcagtggaaggtggacaacgccctgcagagcggcaacagccaggagagcgtgaccgagcaggactccaaggacagcacctacagcctgagcagcaccctgaccctgagcaaggccgactacgagaagcacaaggtgtacgcctgcgaggtgacccaccagggactgtctagccccgtgaccaagagcttcaaccggggcgagtgctaa

SEQ ID NO: 796 - DNA, 651 bp, Artificial Sequence; identical to SEQ ID NO: 790
  847.14H4 light chain DNA sequence

SEQ ID NO: 797 - DNA, 20 bp, Artificial Sequence
  Il6 forward primer
ttccatccagttgccttctt

SEQ ID NO: 798 - DNA, 20 bp, Artificial Sequence
  Il6 reverse primer
cagaattgccattgcacaac

SEQ ID NO: 799 - DNA, 20 bp, Artificial Sequence
  Tnfa forward primer
aagaggcactcccccaaaag

SEQ ID NO: 800 - DNA, 19 bp, Artificial Sequence
  Tnfa reverse primer
gtttgctacgacgtgggct

SEQ ID NO: 801 - DNA, 20 bp, Artificial Sequence
  Il1b forward primer
gcagtggttcgaggcctaat

SEQ ID NO: 802 - DNA, 20 bp, Artificial Sequence
  Il1b reverse primer
tgatactgcctgcctgaagc

SEQ ID NO: 803 - DNA, 22 bp, Artificial Sequence
  Col1a1 forward primer
cctcagggtattgctggacaac

SEQ ID NO: 804 - DNA, 22 bp, Artificial Sequence
  Col1a1 reverse primer
cagaaggaccttgtttgccagg

SEQ ID NO: 805 - DNA, 19 bp, Artificial Sequence
  aSma forward primer
tgaacaagccggtgctctc

SEQ ID NO: 806 - DNA, 20 bp, Artificial Sequence
  aSma reverse primer
ggtcaggatacctcgcttgc

SEQ ID NO: 807 - DNA, 20 bp, Artificial Sequence
  Tgfb forward primer
atgctaaagaggtcacccgc

SEQ ID NO: 808 - DNA, 20 bp, Artificial Sequence
  Tgfb reverse primer
tgccgtacaactccagtgac

SEQ ID NO: 809 - DNA, 22 bp, Artificial Sequence
  Vegfa forward primer
ctgctgtaacgatgaagccctg

SEQ ID NO: 810 - DNA, 22 bp, Artificial Sequence
  Vegfa reverse primer
gctgtaggaagctcatctctcc

SEQ ID NO: 811 - DNA, 22 bp, Artificial Sequence
  Vegfb forward primer
actgggcaacaccaagtccgaa

SEQ ID NO: 812 - DNA, 23 bp, Artificial Sequence
  Vegfb reverse primer
cacattggctgtgttcttccagg

SEQ ID NO: 813 - DNA, 20 bp, Artificial Sequence
  Inos forward primer
aaggcaagcaccttggaaga

SEQ ID NO: 814 - DNA, 20 bp, Artificial Sequence
  Inos reverse primer
ggacagcttctggtcgatgt

SEQ ID NO: 815 - DNA, 22 bp, Artificial Sequence
  Gal3 forward primer
gcccttgcctggaggagtcatg

SEQ ID NO: 816 - DNA, 23 bp, Artificial Sequence
  Gal3 reverse primer
cattgaagcgggggttaaagtgg

SEQ ID NO: 817 - DNA, 23 bp, Artificial Sequence
  Gapdh forward primer
catcactgccacccagaagactg

SEQ ID NO: 818 - DNA, 23 bp, Artificial Sequence
  Gapdh reverse primer
atgccagtgagcttcccgttcag

SEQ ID NO: 819 - protein, 1273 aa, Artificial Sequence
  SARS-CoV-2 spike (S) protein
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 820 - protein, 805 aa, Homo sapiens [sequence omitted]

SEQ ID NO: 821 - protein, 269 aa, Homo sapiens
MAAALFVLLGFALLGTHGASGAAGTVFTTVEDLGSKILLTCSLNDSATEVTGHRWLKGGVVLKEDALPGQKTEFKVDSDDQWGEYSCVFLPEPMGTANIQLHGPPRVKAVKSSEHINEGETAMLVCKSESVPPVTDWAWYKITDSEDKALMNGSESRFFVSSSQGRSELHIENLNMEADPGQYRCNGTSSKGSDQAIITLRVRSHLAALWPFLGIVAEVLVLVTIIFIYEKRRKPEDVLDDDDAGSAPLKSSGQHQNDKGKNVRQRNSS

SEQ ID NO: 822 - protein, 112 aa, Artificial Sequence
  VH-78
QVQLKQSGPELVKPGDSVKISCKAAGYTFSDYYINWVKQRPGQGLEWIGWIYPVSVNTKYNEKFKGKATLTVDTSSSTAYMQLSSLTSEDSGVYFCAYLDYWGQGTLVTVSA

SEQ ID NO: 823 - protein, 112 aa, Artificial Sequence
  VL-75
DVVMTQTPLTLSVTIGQPASISCKSSQSLFHSDGKTYLNWLLQRPGQSPKRLIYLVSKLDSGVPDRFTGSGSGTDFTLKISRVEAEDLGVYYCWQGTHFPLTFGAGTKLEMK

SEQ ID NO: 824 - protein, 112 aa, Artificial Sequence
  VL-76
DVVMTQTPLTLSVTIGQPASISCKSSQSLLHSDGKTYLNWLLQRPGQPPKRLMYLVSTLDSGVPDRFTGSGSGTDFTLKISRVEAEDLGVYYCWQGTHFPLTFGAGTKPELK

SEQ ID NO: 825 - protein, 112 aa, Artificial Sequence
  VL-77
DIVMTQAAFSNPVTLGTSASISCRSSKSLLHSDGITYFYWYLQRPGQSPQLLIYRMSNLASGVPDRFSGSGSGTDFTLRISRVEAEDVGVYYCAQMLEFPLTFGAGTKLERA

SEQ ID NO: 826 - protein, 8 aa, Artificial Sequence
  VH_CDR2_42
IYPGSQDT

SEQ ID NO: 827 - protein, 13 aa, Artificial Sequence
  VH_CDR3_59
ANYFGSSGWFFDV

SEQ ID NO: 828 - protein, 120 aa, Artificial Sequence
  VH-79
QVQLQQSGPELVKPGASVKISCKASGYTFTDYYINWVKQRPGQGLEWIGWIYPGSQDTKYNEKFKGKATLTVDTSSSTAYMQLGSLTSEDSAVYFCANYFGSSGWFFDVWGTGTTVTVSS

SEQ ID NO: 829 - protein, 446 aa, Artificial Sequence
  2D10-VH0-VL0 heavy chain peptide sequence
QVQLQQSGPELVKPGASVKISCKASGYTFTDYYINWVKQRPGQGLEWIGWIYPGSQDTKYNEKFKGKATLTVDTSSSTAYMQLGSLTSEDSAVYFCANYFGSSGWFFDVWGTGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 830 - protein, 219 aa, Artificial Sequence
  2D10-VH0-VL0 light chain peptide sequence
DIVMTQAAFSNPVTLGTSASISCRSSKSLLHSDGITYLYWYLQRPGQSPQLLIYRMSNLASGVPDRFSGSGSGTDFTLRISRVEAEDVGVYYCAQMIEFPLTFGAGTILELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 831 - protein, 125 aa, Artificial Sequence
  hIgG1, Ch2 constant heavy chain domain 2. Fc region
EPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAK

SEQ ID NO: 832 - protein, 326 aa, Artificial Sequence
  hIgG4 Fc region (S228P)
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 833 - protein, 107 aa, Artificial Sequence [sequence omitted]

SEQ ID NO: 834 - DNA, 360 bp, Artificial Sequence
  2D10.2B2 VH DNA sequence
caggtccagctgcagcagtctggacctgagctggtgaagcctggggcttcagtgaagatatcctgcaaggcttctggctacaccttcactgactactatataaactgggtgaagcagaggcctggacagggacttgagtggattggatggatttatcctggaagcaatgataccaagtacaatgagaagttcaagggcaaggccacattgactgtagacacatcctccagcacggcctacatgcagctcggcagcctgacctctgaggactctgcggtctatttctgtgcgaattacttcggttgtagcgggtggttcttcgatgtctggggcacagggaccacagtcaccgtctcctca

SEQ ID NO: 835 - DNA, 336 bp, Artificial Sequence
  2D10.2B2 VL DNA sequence
gatattgtgatgacgcaggctgcattctccaatccagtcactcttggaacgtcagcttccatctcctgcaggtctagtaagagtctcctacatagtgatggcatcacttatttgtattggtatctgcagaggccaggccagtctcctcagctcctgatatatcggatgtccaaccttgcctcaggagtcccagacaggttcagtggcagtgggtcaggaactgatttcacactgagaatcagcagagtggaggctgaggatgtgggtgtttattactgtgctcaaatgatagaattcccgctcacgttcggtgctgggaccatcctggagctgaaa

SEQ ID NO: 836 - DNA, 1356 bp, Artificial Sequence
  2D10.2B2 heavy chain DNA sequence
caggtccagctgcagcagtctggacctgagctggtgaagcctggggcttcagtgaagatatcctgcaaggcttctggctacaccttcactgactactatataaactgggtgaagcagaggcctggacagggacttgagtggattggatggatttatcctggaagcaatgataccaagtacaatgagaagttcaagggcaaggccacattgactgtagacacatcctccagcacggcctacatgcagctcggcagcctgacctctgaggactctgcggtctatttctgtgcgaattacttcggttgtagcgggtggttcttcgatgtctggggcacagggaccacagtcaccgtctcctcagctaagactactcctcccagtgtctaccccctggcccccgtgtgcggcgacacaacaggctcctccgtgacactgggctgcctggtgaaaggctacttccccgagcccgtgacactgacatggaactccggctccctgtcctccggcgtgcacacattccccgccgtgctgcagtccgacctgtacacactgtcctcctccgtgacagtgacatcctccacatggccctcccagtccatcacatgcaacgtggcccaccccgcctcctccacaaaagtggacaaaaaaatcgagcccaggggccccacaatcaaaccctgccccccctgcaaatgccccgcccccaacgccgccggcggcccctccgtgttcatcttcccccccaaaatcaaagacgtgctgatgatctccctgtcccccatcgtgacatgcgtggtggtggacgtgtccgaggacgaccccgacgtgcagatctcctggttcgtgaacaacgtggaggtgcacacagcccagacacagacacacagggaggactacaactccacactgagggtggtgtccgccctgcccatccagcaccaggactggatgtccggcaaagagttcaaatgcaaagtgaacaacaaagacctgggcgcccccatcgagaggacaatctccaaacccaaaggctccgtgagggccccccaggtgtacgtgctgcccccccccgaggaggagatgacaaaaaaacaggtgacactgacatgcatggtgacagacttcatgcccgaggacatctacgtggagtggacaaacaacggcaaaacagagctgaactacaaaaacacagagcccgtgctggactccgacggctcctacttcatgtactccaaactgagggtggagaaaaaaaactgggtggagaggaactcctactcctgctccgtggtgcacgagggcctgcacaaccaccacacaacaaaatccttctccaggacacccggcaaatagtaa

SEQ ID NO: 837 - DNA, 663 bp, Artificial Sequence
  2D10.2B2 light chain DNA sequence
gatattgtgatgacgcaggctgcattctccaatccagtcactcttggaacgtcagcttccatctcctgcaggtctagtaagagtctcctacatagtgatggcatcacttatttgtattggtatctgcagaggccaggccagtctcctcagctcctgatatatcggatgtccaaccttgcctcaggagtcccagacaggttcagtggcagtgggtcaggaactgatttcacactgagaatcagcagagtggaggctgaggatgtgggtgtttattactgtgctcaaatgatagaattcccgctcacgttcggtgctgggaccatcctggagctgaaacgtgctgatgttgcccctactgtgtccatcttccccccctcctccgagcagctgacatccggcggcgcctccgtggtgtgcttcctgaacaacttctaccccaaagacatcaacgtgaaatggaaaatcgacggctccgagaggcagaacggcgtgctgaactcctggacagaccaggactccaaagactccacatactccatgtcctccacactgacactgacaaaagacgagtacgagaggcacaactcctacacatgcgaggccacacacaaaacatccacatcccccatcgtgaaatccttcaacaggaacgagtgctaataa

SEQ ID NO: 838 - protein, 330 aa, Artificial Sequence
  mIgG2A(LALAPG) Fc region
AKTTPPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNAAGGPSVFIFPPKIKDVLMISLSPIVTCVVVDVSEDDPDVQISWFVNNVEVHTAQTQTHREDYNSTLRVVSALPIQHQDWMSGKEFKCKVNNKDLGAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 839 - protein, 330 aa, Artificial Sequence
  mIgG2A(LALA) Fc region
AKTTPPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNAAGGPSVFIFPPKIKDVLMISLSPIVTCVVVDVSEDDPDVQISWFVNNVEVHTAQTQTHREDYNSTLRVVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 840 - protein, 5 aa, Artificial Sequence
  Eiptope Consensus 1
  misc_feature (2)..(2): Xaa can be any naturally occurring amino acid
GXYPG

SEQ ID NO: 841 - protein, 4 aa, Artificial Sequence
  Polypeptide Linker
GGFG

SEQ ID NO: 842 - protein, 4 aa, Artificial Sequence
  Polypeptide linker 2
ALAL

SEQ ID NO: 843 - protein, 4 aa, Artificial Sequence
  Polypeptide linker 3
GFLG

What is claimed is:

1. A method of decreasing or inhibiting inflammation in a subject in need thereof, the method comprising:
   administering to the subject an effective amount of an anti-Gal3 antibody or binding fragment thereof; wherein
   the anti-Gal3 antibody or binding fragment thereof comprises (1) a light chain variable region comprising a $V_L$-CDR1, a $V_L$-CDR2, and a $V_L$-CDR3; and (2) a heavy chain variable region comprising a $V_H$-CDR1, a $V_H$-CDR2, and a $V_H$-CDR3, wherein
   the $V_L$-CDR1 comprises an amino acid that comprise SEQ ID NO: 171, the $V_L$-CDR2 comprises an amino acid sequence that comprise SEQ ID NO: 222, the $V_L$-CDR3 comprises an amino acid sequence that comprise SEQ ID NO: 249; the $V_H$-CDR1 comprises an amino acid that comprise SEQ ID NO: 31, the $V_H$-CDR2 comprises an amino acid sequence that comprise SEQ ID NO: 72, and the $V_H$-CDR3 comprises an amino acid sequence that comprise SEQ ID NO: 113; or
   the $V_L$-CDR1 comprises an amino acid that comprise SEQ ID NO: 195, the $V_L$-CDR2 comprises an amino acid sequence that comprise SEQ ID NO: 247, the $V_L$-CDR3 comprises an amino acid sequence that comprise SEQ ID NO: 292; the $V_H$-CDR1 comprises an amino acid that comprise SEQ ID NO: 39, the $V_H$-CDR2 comprises an amino acid sequence that comprise SEQ ID NO: 103, and the $V_H$-CDR3 comprises an amino acid sequence that comprise SEQ ID NO: 165; or
   the $V_L$-CDR1 comprises an amino acid that comprise SEQ ID NO: 216, the $V_L$-CDR2 comprises an amino acid sequence that comprise SEQ ID NO: 230, the $V_L$-CDR3 comprises an amino acid sequence that comprise SEQ ID NO: 267; the $V_H$-CDR1 comprises an amino acid that comprise SEQ ID NO: 67, the $V_H$-CDR2 comprises an amino acid sequence that comprise SEQ ID NO: 82, and the $V_H$-CDR3 comprises an amino acid sequence that comprise SEQ ID NO: 166; or
   the $V_L$-CDR1 comprises an amino acid that comprise SEQ ID NO: 192, the $V_L$-CDR2 comprises an amino acid sequence that comprise SEQ ID NO: 236, the $V_L$-CDR3 comprises an amino acid sequence that comprise SEQ ID NO: 270; the $V_H$-CDR1 comprises an amino acid that comprise SEQ ID NO: 68, the $V_H$-CDR2 comprises an amino acid sequence that comprise SEQ ID NO: 82, and the $V_H$-CDR3 comprises an amino acid sequence that comprise SEQ ID NO: 167; or
   the $V_L$-CDR1 comprises an amino acid that comprise SEQ ID NO: 217, the $V_L$-CDR2 comprises an amino acid sequence that comprise SEQ ID NO: 229, the $V_L$-CDR3 comprises an amino acid sequence that comprise SEQ ID NO: 293; the $V_H$-CDR1 comprises an amino acid that comprise SEQ ID NO: 69, the $V_H$-CDR2 comprises an amino acid sequence that comprise SEQ ID NO: 109, and the $V_H$-CDR3 comprises an amino acid sequence that comprise SEQ ID NO: 168; or
   the $V_L$-CDR1 comprises an amino acid that comprise SEQ ID NO: 218, the $V_L$-CDR2 comprises an amino acid sequence that comprise SEQ ID NO: 237, the $V_L$-CDR3 comprises an amino acid sequence that comprise SEQ ID NO: 294; the $V_H$-CDR1 comprises an amino acid that comprise SEQ ID NO: 69, the $V_H$-CDR2 comprises an amino acid sequence that comprise SEQ ID NO: 109, and the $V_H$-CDR3 comprises an amino acid sequence that comprise SEQ ID NO: 168; or
   the $V_L$-CDR1 comprises an amino acid that comprise SEQ ID NO: 219, the $V_L$-CDR2 comprises an amino acid sequence that comprise SEQ ID NO: 225, the $V_L$-CDR3 comprises an amino acid sequence that comprise SEQ ID NO: 295; the $V_H$-CDR1 comprises an amino acid that comprise SEQ ID NO: 70, the $V_H$-CDR2 comprises an amino acid sequence that comprise SEQ ID NO: 110, and the $V_H$-CDR3 comprises an amino acid sequence that comprise SEQ ID NO: 169; or the $V_L$-CDR1 comprises an amino acid that comprise SEQ ID NO: 220, the $V_L$-CDR2 comprises an amino acid sequence that comprise SEQ ID NO: 227, the $V_L$-CDR3 comprises an amino acid sequence that comprise SEQ ID NO: 296; the $V_H$-CDR1 comprises an amino acid that comprise SEQ ID NO: 43, the $V_H$-CDR2 comprises an amino acid sequence that comprise SEQ ID NO: 111, and the $V_H$-CDR3 comprises an amino acid sequence that comprise SEQ ID NO: 138; and wherein administration of the effective amount of the anti-Gal3 antibody or binding fragment thereof decreases or inhibits neutrophil activation and/or migration in the subject, decreases or inhibits cleavage of CD62L expressed by neutrophils, decreases or inhibits IL-8 production in the subject, decreases the number of neutrophils in the subject, and/or modulates expression of myeloperoxidase (MPO), growth-related oncogene α (GROα)/keratinocytes-derived chemokine (KC), Ly6c1, INOS, IL-6, TNFα, IL-1B, Col1A1, aSMA, TGFβ, VEGFA, VEGFB, or any combination thereof, in the subject.

2. The method of claim 1, wherein the inflammation in the subject is associated with neutrophil activation and/or migration.

3. The method of claim 1, further comprising detecting a decrease in neutrophil CD62L cleavage, a decrease in IL-8 production in the subject, a decrease in the number of neutrophils in the subject, or any combination thereof, a change in expression of Gal3, MPO, GROα/KC, Ly6c1, INOS, IL-6, TNFα, IL-1B, Col1A1, aSMA, TGFβ, VEGFA, VEGFB, or any combination thereof, in the subject, and/or an improvement in the inflammation in the subject, after the administering step.

4. The method of claim 1, wherein administration of the effective amount of the anti-Gal3 antibody or binding fragment thereof decreases production of autoantibodies in the subject.

5. The method of claim 4, wherein the autoantibodies are anti-nucleic acid autoantibodies.

6. The method of claim 1, wherein the inflammation comprises lung inflammation, COPD, pneumonitis, asthma, sarcoidosis, pulmonary fibrosis, histiocytosis, bronchiolitis obliterans, or any combination thereof.

7. The method of claim 1, wherein the inflammation comprises an autoimmune disease, systemic lupus erythematosus (SLE), Graves' disease, rheumatoid arthritis, multiple sclerosis, Sjogren's syndrome, celiac disease, or any combination thereof.

8. The method of claim 1, wherein the anti-Gal3 antibody or binding fragment thereof binds to Peptide 4 (GAGGYPGASYPGAYPGQAPP; SEQ ID NO: 6), Peptide 6 (GAYPGQAPPGAYPGAPGAYP; SEQ ID NO: 8), or Peptide 7 (AYPGAPGAYPGAPAPGVYPG; SEQ ID NO: 9).

9. The method of claim 1, wherein the anti-Gal3 antibody or binding fragment thereof is selected from the group consisting of: TB006, 849.5H1, 847.23F11, 847.16D10, 847.13E2-mH0mL1, 847.13E2-mH0mL2, 847.12C4, 847.4D3, or binding fragment thereof.

* * * * *